US012115230B2

(12) United States Patent
Chadwick et al.

(10) Patent No.: US 12,115,230 B2
(45) Date of Patent: Oct. 15, 2024

(54) BASE EDITING OF ANGPTL3 AND METHODS OF USING SAME FOR TREATMENT OF DISEASE

(71) Applicant: Verve Therapautics, Inc., Boston, MA (US)

(72) Inventors: Alexandra Chadwick, Somerville, MA (US); Kallanthottathil G. Rajeev, Wayland, MA (US); Ellen Rohde, Ashland, MA (US); Christopher Cheng, North Reading, MA (US); Caroline Reiss, Somerville, MA (US)

(73) Assignee: VERVE THERAPEUTICS, INC., Boston, MA (US)

( * ) Notice: Subject to any disclaimer, the term of this patent is extended or adjusted under 35 U.S.C. 154(b) by 0 days.

(21) Appl. No.: 17/918,092

(22) PCT Filed: Apr. 9, 2021

(86) PCT No.: PCT/US2021/026729
§ 371 (c)(1),
(2) Date: Oct. 10, 2022

(87) PCT Pub. No.: WO2021/207710
PCT Pub. Date: Oct. 14, 2021

(65) Prior Publication Data
US 2023/0340435 A1 Oct. 26, 2023

Related U.S. Application Data

(60) Provisional application No. 63/136,087, filed on Jan. 11, 2021, provisional application No. 63/045,032, filed on Jun. 26, 2020, provisional application No. 63/045,033, filed on Jun. 26, 2020, provisional application No. 63/007,803, filed on Apr. 9, 2020, provisional application No. 63/007,797, filed on Apr. 9, 2020.

(51) Int. Cl.
| | | |
|---|---|---|
| *C12N 15/11* | (2006.01) | |
| *A61K 9/127* | (2006.01) | |
| *A61K 31/7105* | (2006.01) | |
| *A61K 38/46* | (2006.01) | |
| *A61K 48/00* | (2006.01) | |
| *C07K 14/515* | (2006.01) | |
| *C12N 9/22* | (2006.01) | |
| *C12N 15/113* | (2010.01) | |
| *C12N 15/90* | (2006.01) | |

(52) U.S. Cl.
CPC .......... *A61K 48/0066* (2013.01); *A61K 9/127* (2013.01); *A61K 31/7105* (2013.01); *A61K 38/465* (2013.01); *C07K 14/515* (2013.01); *C12N 9/22* (2013.01); *C12N 15/11* (2013.01); *C12N 15/113* (2013.01); *C12N 15/907* (2013.01); *C07K 2319/09* (2013.01); *C07K 2319/80* (2013.01); *C12N 2310/20* (2017.05); *C12N 2310/315* (2013.01); *C12N 2310/321* (2013.01); *C12N 2310/331* (2013.01); *C12N 2310/335* (2013.01); *C12N 2310/344* (2013.01); *C12N 2310/3521* (2013.01); *C12N 2800/80* (2013.01)

(58) Field of Classification Search
None
See application file for complete search history.

(56) References Cited

U.S. PATENT DOCUMENTS

| | | |
|---|---|---|
| 7,371,404 B2 | 5/2008 | Panzner et al. |
| 7,780,983 B2 | 8/2010 | Panzner et al. |
| 7,858,117 B2 | 12/2010 | Panzner et al. |
| 8,021,686 B2 | 9/2011 | Semple et al. |
| 8,236,770 B2 | 8/2012 | Endert et al. |
| 9,175,093 B2 | 11/2015 | Liang et al. |
| 2003/0119038 A1 | 6/2003 | Bingham et al. |
| 2004/0009553 A1 | 1/2004 | Glucksmann et al. |
| 2007/0087045 A1 | 4/2007 | Li et al. |
| 2012/0082680 A1 | 4/2012 | Sitlani et al. |
| 2016/0200779 A1 | 7/2016 | Liu et al. |
| 2016/0208288 A1 | 7/2016 | Liu et al. |
| 2016/0264981 A1 | 9/2016 | Yang et al. |
| 2016/0375134 A1 | 12/2016 | Bancel et al. |
| 2017/0266276 A1 | 9/2017 | Gurney et al. |
| 2018/0147298 A1 | 5/2018 | Besin et al. |
| 2018/0163213 A1 | 6/2018 | Aneja et al. |
| 2018/0200186 A1 | 7/2018 | Chen et al. |

(Continued)

FOREIGN PATENT DOCUMENTS

| | | |
|---|---|---|
| CN | 110430894 A | 11/2019 |
| EP | 1067182 A2 | 1/2001 |

(Continued)

OTHER PUBLICATIONS

"Abifadel, M. et al., "Identification and characterization of new gain-of-function mutations in the PCSK9 gene responsible for autosomal dominant hypercholesterolemia," Atherosclerosis, 2012, vol. 223, No. 2, pp. 394-400".
"Abifadel, M. et al, "Mutations in PCSK9 cause autosomal dominant hypercholesterolemia," Nature Genetics, 2003, vol. 34, No. 2, pp. 154-156".
"Sander, J. D. et al., "CRISPR-Cas systems for editing, regulating and targeting genomes," Nature Biotechnology, 2014, vol. 32, pp. 347-355".
"Anzalone, A.V. et al., "Genome editing with CRISPR-Cas nucleases, base editors, transposases and prime editors," Nat Biotechnol, 2020, vol. 38, No. 7, pp. 824-844".

(Continued)

*Primary Examiner* — Ekaterina Poliakova-Georgantas
(74) *Attorney, Agent, or Firm* — Wilson Sonsini Goodrich & Rosati

(57) ABSTRACT

Provided herein are compositions for gene modification or editing and methods of using same to treat or prevent certain conditions. Specific compositions and methods capable of safely and effectively editing gene targets expressed in the liver to durably lower LDL-C thereby treating a leading cause of cardiovascular disease are disclosed.

22 Claims, 84 Drawing Sheets

Specification includes a Sequence Listing.

(56) References Cited

U.S. PATENT DOCUMENTS

| | | | |
|---|---|---|---|
| 2018/0290965 | A1 | 10/2018 | Brito et al. |
| 2019/0062755 | A1 | 2/2019 | Freier et al. |
| 2020/0157565 | A1 | 5/2020 | Lundberg et al. |
| 2022/0403396 | A1 | 12/2022 | Xu et al. |
| 2023/0159926 | A1 | 5/2023 | Chadwick et al. |

FOREIGN PATENT DOCUMENTS

| | | |
|---|---|---|
| EP | 1471152 A1 | 10/2004 |
| EP | 4133071 A2 | 2/2023 |
| JP | 2015514076 A | 5/2015 |
| JP | 2016530294 A | 9/2016 |
| JP | 2016534928 A | 11/2016 |
| JP | 2020508056 A | 3/2020 |
| WO | WO-0131007 A2 | 5/2001 |
| WO | WO-0134768 A2 | 5/2001 |
| WO | WO-0138547 A2 | 5/2001 |
| WO | WO-0157081 A2 | 8/2001 |
| WO | WO-0177137 A1 | 10/2001 |
| WO | WO-0198468 A2 | 12/2001 |
| WO | WO-0214358 A2 | 2/2002 |
| WO | WO-0246383 A2 | 6/2002 |
| WO | WO-2006007712 A1 | 1/2006 |
| WO | WO-2013143555 A1 | 10/2013 |
| WO | WO-2015034928 A1 | 3/2015 |
| WO | WO-2015199952 A1 | 12/2015 |
| WO | WO-2017004143 A1 | 1/2017 |
| WO | WO-2017075531 A1 | 5/2017 |
| WO | WO-2017173054 A1 | 10/2017 |
| WO | WO-2018107028 A1 | 6/2018 |
| WO | WO-2018119354 A1 | 6/2018 |
| WO | WO-2018119514 A1 | 7/2018 |
| WO | WO-2018144775 A1 | 8/2018 |
| WO | WO-2018154380 A1 | 8/2018 |
| WO | WO-2018154387 A1 | 8/2018 |
| WO | WO-2018183808 A1 | 10/2018 |
| WO | WO-2018191719 A1 | 10/2018 |
| WO | WO-2019005884 A1 | 1/2019 |
| WO | WO-2019025431 A1 | 2/2019 |
| WO | WO-2019036028 A1 | 2/2019 |
| WO | WO-2019067910 A1 | 4/2019 |
| WO | WO-2019067992 A1 | 4/2019 |
| WO | WO-2019067999 A1 | 4/2019 |
| WO | WO-2019123183 A1 | 11/2019 |
| WO | WO-2019217941 A1 | 11/2019 |
| WO | WO-2019226953 A1 | 11/2019 |
| WO | WO-2020051561 A1 | 3/2020 |
| WO | WO-2020061426 A2 | 3/2020 |
| WO | WO-2020081938 A1 | 4/2020 |
| WO | WO-2021178725 A1 | 9/2021 |
| WO | WO-2021207710 A2 | 10/2021 |
| WO | WO-2022060871 A1 | 3/2022 |

OTHER PUBLICATIONS

"Bae, S. et al., "Cas-OFFinder: A fast and versatile algorithm that searches for potential off-target sites of Cas9 RNA-guided endonucleases," Bioinformatics, 2014, vol. 30, No. 10, pp. 1473-1475".

"Baker, K. E. et al., "Nonsense-mediated mRNA decay: terminating erroneous gene expression," Current Opinion in Cell Biology, 2004, vol. 16, No. 3, pp. 293-299".

"Batzer, M. A. et al., "Enhanced evolutionary PCT using oligo-nucleotides with inosine at the 3'-terminus," Nucleic Acid Res., 1991, vol. 19, No. 18, pp. 5081".

"Behm-Ansmant, I. et al., "Quality control of gene expression: a stepwise assembly pathway for the surveillance complex that triggers nonsense-mediated mRNA decay," Genes & Development, 2006, vol. 20, No. 4, pp. 391-398".

"Benjannet, S. et al., "Loss- and Gain-of-function PCSK9 Variants," J Biol Chem., 2012, vol. 287, No. 40, pp. 33745-33755".

"Benjannet, S. et al., "NARC-1/PCSK9 and its natural mutants: zymogen cleavage and effects on the low density lipoprotein (LDL) receptor and LDL cholesterol," J. Biol. Chem., 2004, vol. 279, No. 47, pp. 48865-48875".

"Bolger, A. M. et al., "Trimmomatic: a flexible trimmer for Illumina sequence data," Bioinformatics, 2014, vol. 30, No. 15, pp. 2114-2120".

"Burstein, D. et al., "New CRISPR-Cas systems from uncultivated microbes," Cell Res., 2017, vol. 542, No. 7640, pp. 237-241".

"Cameron, J. et al., "Effect of mutations in the PCSK9 gene on the cell surface LDL receptors," Hum. Mol. Genet., 2006, vol. 15, No. 9, pp. 1551-1558".

"Carroll, D., "Genome engineering with zinc-finger nucleases," Genetics Society of America, 2011, vol. 188, No. 4, pp. 773-782".

"Chadwick, A. C. et al., "Reduced Blood Lipid Levels With In Vivo CRISPR-Cas9 Base Editing of ANGPTL3," Circulation, 2018, vol. 137, No. 9, pp. 975-977".

"Chadwick, A. et al., "In Vivo Base Editing of PCSK9 (Proprotein Convertase Subtilisin/Kexin Type 9) as a Therapeutic Alternative to Genome Editing," Arterioscler Thromb Vasc Biol, 2017, vol. 37, No. 9, pp. 1741-1747".

"Chang, Y. F. et al., "The nonsense-mediated decay RNA surveillance pathway," Annual Review of Biochemistry, 2007, vol. 76, pp. 51-74".

"Chavez, A. et al., "Highly-efficient Cas9-mediated transcriptional programming," Nature Methods, 2015, vol. 12, pp. 326-328".

"Scholtz, C. L. et al., "Mutation −59c→t in Repeat 2 of the LDL Receptor Promoter: Reduction in Transcriptional Activity and Possible Allelic Interaction in a South African Family with Familial Hypercholesterolemia," Hum. Mol. Genet., 1999, vol. 8, No. 11, pp. 2025-2030".

Christian, M. et al, "Targeting DNA double-strand breaks with TAL effector nucleases," Genetics, 2008, vol. 186, No. 2, pp. 757-761.

"Chu, V. T. et al., "Increasing the efficiency of homology-directed repair for CRISPR-Cas9- induced precise gene editing in mammalian cells," Nature Biotechnology, 2015, vol. 33, pp. 543-548".

"Chylinski, K. et al., "The tracrRNA and Cas9 families of type II CRISPR-Cas immunity systems," RNA Biology, 2013, vol. 10, No. 5, pp. 726-737".

"Cohen, J. C. et al., "Sequence Variations in PCSK9, Low LDL, and Protection against Coronary Heart Disease," N. Engl. J. Med., 2006, vol. 354, pp. 1264-1272".

"Cong, L. et al., "Multiplex genome engineering using CRISPR/Cas systems," Science, 2013, vol. 339, pp. 819-823".

"Conway, A. et al., "Non-viral Delivery of Zinc Finger Nuclease mRNA Enables Highly Efficient In Vivo Genome Editing of Multiple Therapeutic Gene Targets," Mol Therapy, 2019, vol. 27, No. 4, pp. 866-877".

"Damha, M. J. et al., "Oligoribonucleotide synthesis. The silyl-phosphonamidite method," Methods in Molecular Biology, 1993, vol. 20, pp. 81-114".

"De Castro-Oros, I. et al., "A genetic variant in the LDLRpromoter is responsible for part of the LDL-cholesterol variability in primary hypercholesterolemia," BMC Medical Genomics, 2014, vol. 17, pp. 1-8".

"Deltcheva, E. et al., "CRISPR RNA maturation by trans-encoded small RNA and host factor RNase III.," Nature, 2011, vol. 471, No. 7340, pp. 602-607".

"Dicarlo, J. E. et al., "Genome engineering in *Saccharomyces cerevisiae* using CRISPR-Cas systems," Nucleic acids research, 2013, vol. 41, No. 7, pp. 4336-4343".

"Dubuc, G. et al., "Statins upregulate PCSK9, the gene encoding the proprotein convertase neural apoptosis-regulated convertase-1 implicated in familial hypercholesterolemia," Thromb. Vasc. Biol., 2004, vol. 24, No. 8, pp. 1454-1459".

"Seidah, N. G. et al., "The biology and therapeutic targeting of the proprotein convertases," Nat Rev Drug Discov, 2012, vol. 11, No. 5, pp. 367-383".

"Seidah, N. G. et al., "The secretory proprotein convertase neural apoptosis-regulated convertase 1 (NARC-1): Liver regeneration and neuronal differentiation," PNAS, 2003, vol. 100, No. 3, pp. 928-933".

"Seidah, N. G. "PCSK9 as a therapeutic target of dyslipidemia," Expert Opin Ther Targets, 2009, vol. 13, No. 1, pp. 19-28".

(56) References Cited

OTHER PUBLICATIONS

"Ferretti, J. J. et al., "Complete genome sequence of an MI strain of *Streptococcus pyogenes*," Natl. Acad. Sci., 2001, vol. 98, No. 8, pp. 4658-4663".
"Finn, J. et al., "A single administration of CRISPR/Cas9 lipid nanoparticles achieves robust and persistent in vivo genome editing," Cell Reports, 2018, vol. 22, pp. 2227-2235".
"Fu, Y. et al., "High-frequency off-target mutagenesis induced by CRISPR-Cas nucleases in human cells," Nature Biotechnology, 2013, vol. 31, No. 9, pp. 822-826".
"Gaudelli, N. M. et al., "Programmable base editing of A•T to G•C in genomic DNA without DNA cleavage," Nature, 2017, vol. 551, No. 7681, pp. 464-471".
"Grunewald, J. et al., "CRISPR DNA base editors with reduced RNA off-target and self-editing activities," Nat Biotechnol, 2019, vol. 37, pp. 1041-1048".
"Grunewald, J. et al., "Transcriptome-wide off-target RNA editing induced by CRISPR-guided DNA base editors," Nature, 2019, vol. 569, pp. 433-437".
"Gu, H. M. et al., "Characterization of the role of EGF-A of low density lipoprotein receptor in PCSK9 binding," J Lipid Res., 2013, vol. 54, No. 12, pp. 3345-3357".
"Shmakov, S. et al., "Discovery and functional characterization of diverse class 2 CRISPR-Cas systems," Molecular Cell, 2015, vol. 60, No. 3, pp. 1-13".
"Hooper, A. J. et al., "Anti-PCSK9 therapies for the treatment of hypercholesterolemia," Expert Opin Biol Ther, 2013, vol. 13, No. 3, pp. 429-435".
"HSU, P. D. et al., "Development and Applications of CRISPR-Cas9 for Genome Engineering," Cell, 2014, vol. 157, No. 6, pp. 1262-1278".
"Hwang, W. Y. et al., "Efficient genome editing in zebrafish using a CRISPR-Cas system," Nature biotechnology, 2013, vol. 31, pp. 227-229".
"Jiang, W. et al., "RNA-guided editing of bacterial genomes using CRISPR-Cas systems," Nature biotechnology, 2013, vol. 31, pp. 233-239".
"Jin, S. et al., "Cytosine, but not adenine, base editors induce genome-wide off-target mutations in rice," Science, 2019, vol. 364: 292-5".
"Jinek, M. et al., A programmable Dual-RNA-Guided DNA endonuclease in adaptive bacterial immunity, Science, 2012, vol. 337, No. 6096, pp. 816-821".
"Jinek, M. et al., "RNA-programmed genome editing in human cells," eLife, 2013, vol. 2, pp. 1-9".
"Jorgensen, A. B. et al., "Loss-of-Function Mutations in APOC3 and Risk of Ischemic Vascular Disease," N Engl J Med, 2014, vol. 371, pp. 32-41".
"Kim, Y. B. et al., "Increasing the genome-targeting scope and precision of base editing with engineered Cas9-cytidine deaminase fusions," Nat Biotechnol, 2017, vol. 35, No. 4, pp. 371-376".
"Kleinstiver, B. P., et al., "Broadening the targeting range of *Staphylococcus aureus* CRISPR-Cas9 by modifying PAM recognition," Nature Biotechnology, 2015, vol. 33, pp. 1293-1298".
"Kleinstiver, B. P., et al., "Engineered CRISPR-Cas9 nucleases with altered PAM specificities," Nature, 2015, vol. 523, No. 7561, pp. 481-485".
"Kleinstiver, B. P. et al., "High-fidelity CRISPR-Cas9 nucleases with no detectable genome-wide off-target effects," Nature, 2016, vol. 529, pp. 490-495".
"Koblan, L. W. et al., "Improving cytidine and adenine base editors by expression optimization and ancestral reconstruction," Nat Biotechnol, 2018, vol. 36, No. 9, pp. 843-846".
"Komor, A. C. et al., "Improved base excision repair inhibition and bacteriophage Mu Gam protein yields C:G-to-T:A base editors with higher efficiency and product purity," Sci Adv, 2017, vol. 3, No. 8, pp. 1-9".
"Komor, A. C. et al., "Programmable editing of a target base in genomic DNA without double-stranded DNA cleavage," Nature, 2016, vol. 533, pp. 420-424".

"Kowalksa, J. et al., "Synthesis and characterization of mRNA cap analogs containing phosphonothioate substitutions that bind tightly to eIF4E and are resistant to the decapping pyrophosphatase DcpS," RNA, 2008, vol. 14, No. 6, pp. 1119-1131".
"Lalanne, F. et al., "Wild-type PCSK9 inhibits LDL clearance but does not affect apoB-containing lipoprotein production in mouse and cultured cells," J. Lipid Research, 2005, vol. 46, pp. 1312-1319".
"Slaymaker, I. M., et al., "Rationally engineered Cas9 nucleases with improved specificity," Science, 2015, vol. 351, No. 6268, pp. 84-88".
"Leren, T. P. "Mutations in the PCSK9 gene in Norwegian subjects with autosomal dominant hypercholesterolemia," Clin. Genet., 2004, vol. 65, pp. 419-422".
"Li, T. et al., "TAL nucleases (TALNs): hybrid proteins composed of TAL effectors and FokI DNA-cleavage domain," Nucleic Acids Res., 2010, vol. 39, No. 1, pp. 359-372".
"Li, X. et al., "Base editing with a Cpf1-cytidine deaminase fusion," Nat Biotechnol, 2018, vol. 36, No. 4, pp. 324-327".
"Lim, J. et al., "Characterization of magnetic nanoparticle by dynamic light scattering," Nanoscale Research Letters, 2013, vol. 8, No. 1".
"Liu, L. et al., "C2c1-sgRNA Complex Structure Reveals RNA-Guided DNA Cleavage Mechanism," Mol. Cell, 2017, vol. 65, No. 2, pp. 310-322".
"Maeder, M. L. et al., "Rapid "open-source" engineering of customized zinc-finger nucleases for highly efficient gene modification," Cell, 2008, vol. 31, No. 2, pp. 294-301".
"Magoc, T. et al., "FLASH: fast length adjustment of short reads to improve genome assemblies," Bioinformatics, 2011, vol. 27, No. 21, pp. 2957-2963".
"Makarova, K. S. et al., "An updated evolutionary classification of CRISPR-Cas systems," Nature Reviews Microbiology, 2015, vol. 13, No. 11, pp. 722-736".
"Mali, P. et al., "Cas9 as a versatile tool for engineering biology," Nat Methods, 2013, vol. 10, No. 10, 957-963".
"Mali, P. et al., "CAS9 transcriptional activators for target specificity screening and paired nickases for cooperative genome engineering," Nature Biotechnology, 2013, vol. 31, No. 9, pp. 833-838".
"Mali, P. et al., "RNA-guided human genome engineering via Cas9," Science, 2013, vol. 339, pp. 823-826".
"Matsuda, S. et al., "siRNA conjugates carrying sequentially assembled trivalent N-acetylgalactosamine linked through nucleosides elicit robust gene silencing in vivo in hepatocytes," ACS Chem. Biol., 2015, vol. 10, No. 5, pp. 1181-1187".
"Maxwell, K. N. et al., "Adenoviral-mediated expression of Pcsk9 in mice results in a low-density lipoprotein receptor knockout phenotype," Proc. Nat. Acad. Sci, 2004, vol. 101, No. 18, pp. 7100-7105".
"Maxwell, K. N. et al., "Overexpression of PCSK9 accelerates the degradation of the LDLR in a post-endoplasmic reticulum compartment," PNAS, 2005, vol. 102, No. 6, pp. 2069-2074".
"Micklefield, J. "Backbone modification of nucleic acids: synthesis, structure and therapeutic applications," Curr. Med. Chem., 2001, vol. 8, No. 10, pp. 1157-1179".
"Miller, J. C. et al., "An improved zinc-finger nuclease architecture for highly specific genome editing," Nature Biotechnology, 2007, vol. 25, No. 7, pp. 778-785".
"Moscou, M. J. et al., "A simple cipher governs DNA recognition by TAL effectors," Science, 2009, vol. 326, No. 5959, pp. 1501".
"Nishida, K. et al., "Targeted nucleotide editing using hybrid prokaryotic and vertebrate adaptive immune systems," Science, 2016, vol. 353".
"O'Donoghue, M. L. et al., "Lipoprotein(a), PCSK9 Inhibition, and Cardiovascular Risk : Insights From the Fourier Trial," Circulation, 2019, vol. 139, No. 12, pp. 1483-1492".
"Ohtsuka, E. et al., "An alternative approach to deoxyoligonucleotides as hybridization probes by insertion of deoxyinosine at ambiguous codon positions," J. Biol. Chem., 1985, vol. 260, No. 5, pp. 2605-2608".
"Song, C. Q. et al., "Adenine base editing in an adult mouse model of tyrosinemia," Nat Biomed Eng, 2020, vol. 4, No. 1, pp. 125-130".

(56) References Cited

OTHER PUBLICATIONS

"Park, S. W. et al., "Post-transcriptional regulation of low density lipoprotein receptor protein by proprotein convertase subtilisin/kexin type 9a in mouse liver," J. Biol. Chem., 2004, vol. 279, No. 48, pp. 50630-50638".
"Peterson, A. S. et al., "PCSK9 function and physiology," J Lipid Res., 2008, vol. 49, No. 6, pp. 1152-1156".
"Pisciotta, L. et al., "Characterization of three kindreds with familial combined hypolipidemia caused by loss-of-function mutations of ANGPTL3," Circ Cardiovasc Genet, 2012, vol. 5, No. 1, pp. 42-50".
"Qi, L. S. et al, "Repurposing CRISPR as an RNA-guided platform for sequence-specific control of gene expression," Cell, 2013, vol. 152, No. 5, pp. 1173-1183".
"Rashid, S. et al., "Decreased plasma cholesterol and hypersensitivity to statins in mice lacking Pcsk9," PNAS, 2005, vol. 102, No. 15, pp. 5374-5379".
"Rees, H. A. et al., "Analysis and minimization of cellular RNA editing by DNA adenine base editors," Sci Adv, 2019, vol. 5, No. 5, pp. 1-10".
"Rees, H. A. et al., "Base editing: precision chemistry on the genome and transcriptome of living cells," Nat. Rev. Genet., 2018, vol. 19, No. 12, pp. 770-788".
"Rees, H. A. et al., "Improving the DNA specificity and applicability of base editing through protein engineering and protein delivery," Nat Commun, 2017, vol. 8, pp. 1-10".
"Rejman, J. et al., "Characterization and transfection properties of lipoplexes stabilized with novel exchangeable polyethylene glycol-lipid conjugates," Biochimica Biophysica Acta, 2004, vol. 1660, pp. 41-52".
"Rossidis, A. C. et al., "In utero CRISPR-mediated therapeutic editing of metabolic genes," Nat Med, 2018, vol. 24, No. 10, pp. 1513-1518".
"Rossolini, G. M. et al., "Use of deoxyinosine-containing primers vs degenerate primers for polymerase chain reaction based on ambiguous sequence information," Mol. Cell. Probes, 1994, vol. 8, pp. 91-98".
"Ryu, S. M. et al., "Adenine base editing in mouse embryos and an adult mouse model of Duchenne muscular dystrophy," Nat Biotechnol, 2018, vol. 36, No. 6, pp. 536-539".
"Timms, K. M. et al., "A mutation in PCSK9 causing autosomal-dominant hypercholesterolemia in a Utah pedigree," Hum. Genet., 2004, vol. 114, No. 4, pp. 349-353".
"Sun, X. M. et al., "Evidence for effect of mutant PCSK9 on apolipoprotein B secretion as the cause of unusually severe dominant hypercholesterolemia," Hum. Mol. Genet, 2005, vol. 14, No. 9, pp. 1161-1169".
"Villiger, L. et al., "In vivo cytidine base editing of hepatocytes without detectable off-target mutations in RNA and DNA," Nat Biomed Eng, 2021, vol. 5, No. 2, pp. 179-18".
"Villiger, L. et al., "Treatment of a metabolic liver disease by in vivo genome base editing in adult mice," Nat Med, 2018, vol. 24, No. 10, pp. 1519-1525".
"Wang, X. et al., "Angiopoietin-Like 3: From Discovery to Therapeutic Gene Editing," JACC: Basic to Translational Science, 2019, vol. 4, No. 6, pp. 755-762".
"Swarts, D. C. et al., "Argonaute of the *Pyrococcus furiosus* is a DNA-guided nuclease that targets cognate DNA," Nucleic Acids Res, 2015, vol. 43, No. 10, pp. 5120-5129".
"Swarts, D. C. et al., "DNA-guided DNA interference by a prokaryotic Argonaute," Nature, 2014, vol. 507, No. 7491, pp. 258-261".
"Yang, H. et al., "PAM-dependent Target DNA Recognition and Cleavage by C2C1 CRISPR-Cas Endonuclease," Cell, 2016, vol. 167, No. 7, pp. 1814-1828".
"Yardeni, T. et al., "Retro-orbital injections in mice," Lab Anim, 2011, vol. 40, No. 5, pp. 155-160".
"Yeh, W. H. et al., "In vivo base editing of post-mitotic sensory cells," Nat Commun, 2018, vol. 9, No. 2184, pp. 1-10".
"Zhou, C. et al., "Off-target RNA mutation induced by DNA base editing and its elimination by mutagenesis," Nature, 2019, vol. 571, pp. 275-278".
"Zuo, E. et al., "Cytosine base editor generates substantial off-target single-nucleotide variants in mouse embryos," Science, 2019, vol. 364, pp. 289-292".
International Search Report and Written Opinion issued in PCT/US2021/026729, dated Mar. 22, 2022.
International Preliminary Report on Patentability issued in PCT/US2021/026729, dated Nov. 5, 2021.
EP21783997.6 Extended European Search Report dated Mar. 27, 2024.
Gao, Feng, et al., DNA-guided Genome Editing using the Natronobacterium Gregoryi Argonaute. Nature Biotechnology 34:768-773 (2016).
International Search Report and Written Opinion issued in PCT/US21/26732, mailed Nov. 5, 2021.
Jiang, F. et al., "Structures of a CRISPR-Cas9 R-loop complex primed for DNA cleavage," Science, 2016, vol. 351, No. 6275, pp. 867-871.
Musunuru, Kiran, et al., In vivo CRISPR base Editing of PCSK9 Durably Lowers Cholesterol in Primates. Nature 593(7859):429-434 (2021).
Gaudelli et al.: Directed evolution of adenine base editors with increased activity and therapeutic application. Nat Biotechnol. 38(7):892-900 doi: 10.1038/s41587-020-0491-6 (2020).
Valencia-Enciso et al., New Biotechnological Treatments for Lipid Disorders, Rev. Invest. Clin. 70(5):244-254 (2018).

| PDB ID | Components | State |
|---|---|---|
| 4CMP | SpCas9 protein | Apo (pre-RNP formation) |
| 4ZT0 | SpCas9 protein + gRNA | RNP (forms in cytosol) |
| 5F9R | SpCas9 protein + gRNA + target/non-target DNA | Pre-catalytic ternary complex |
| 4UN3 | SpCas9 protein + gRNA + target/non-target DNA | Post-catalytic ternary complex |

|  | 4CMP | 4ZT0 | 5F9R | 4UN3 |
|---|---|---|---|---|
| 4CMP |  | 15 | 20 | 20 |
| 4ZT0 | 15 |  | 4 | 3 |
| 5F9R | 20 | 4 |  | 2 |
| 4UN3 | 20 | 3 | 2 |  |

FIG. 2

```
              10         20         30         40         50         60         70         80
              123456789X 123456789X 123456789X 123456789X 123456789X 123456789X 123456789X 123456789X
SEQ ID NO: 61 GUUUUAGAGC UAGAAAUAGC AAGUAAAAAU AAGGCUAGUC CGUUAUCAAC UUGAAAAAGU GGCACCGAGU CGGUGCUUUU
Lit Tracr     GUUUUAGAGc uagaaauagc AAGUAAAAAU AAGGCUAGUC CGUUAUCAAc uugaaaaagu ggcaccgagu cggugcususu su
Tracr1        gUUUUAGAgc uaGaaauagc aaGUaaAaAu AaggCUaGUC cGUUAuCAAc uuGaaaaagu GgCaccgAgU Cggugcususu su
Tracr2        gUUUUAGAgc uagaaauagc aaGUaAaAAu AaggcuaGUc cGUUAucAAc uugaaaaagu gGcaccgagu cggugcususu su
Tracr3        gUUUUAGAgc uaGaaauagc aaGUaAaAAu AaggcuaGUc cGUUAucAAc uuGaaaaagu gGcaccgagu cggugcususu su
```

FIG. 7B

BASE EDITING OF ANGPTL3 AND METHODS OF USING SAME FOR TREATMENT OF DISEASE

CROSS REFERENCE TO RELATED APPLICATIONS

This application claims benefit under 35 U.S.C. § 119 from Provisional Application Ser. No. 63/007,803, filed Apr. 9, 2020; Provisional Application Ser. No. 63/007,797, filed Apr. 9, 2020; Provisional Application Ser. No. 63/136,087, filed Jan. 11, 2021; Provisional Application Ser. No. 63/045,032, filed Jun. 26, 2020; Provisional Application Ser. No. 63/045,033, filed Jun. 26, 2020, the disclosures of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Apr. 8, 2021, is named 53989_711_601_SL.txt and is 1,105,762 bytes in size.

LARGE TABLES LARGE TABLES

The instant application contains Large Tables which have been submitted in read-only optical discs in electronic form in ASCII plain text format and are hereby incorporated by reference in their entirety. Said read-only optical discs, created on Feb. 13, 2024, are named "53989_711831_Table23" (168,178 bytes) and "53989_711831_Table24" (269,593 bytes).

FIELD OF DISCLOSURE

Provided herein are compositions for gene modification or editing, and methods of using same that are capable of treating or preventing certain conditions, such as cardiovascular disease and conditions or diseases associated therewith such as diabetes.

BACKGROUND

All publications, patents, and patent applications mentioned in this specification are herein incorporated by references to the same extent as if each individual publication, patent, or patent application was specifically and individually indicated to be incorporated by reference. It is not an admission that any publication or information specifically or implicitly referenced herein is prior art or necessarily relevant to the claimed subject matter. To the extent publications or patents or patent applications incorporated by reference contradict or are inconsistent with the disclosure contained in the specification, such cited or incorporated references should be considered supplementary to this disclosure with the understanding that the specification is intended to supersede and/or take precedence over any irreconcilable inconsistencies or contradictory material.

SUMMARY

The inventive subject matter disclosed in this application is directed to compositions capable of editing a polynucleotide or target gene and methods of use of those compositions. The compositions and the constituent components thereof, individually and in combination, are considered separate aspects of the inventive subject matter, which may be defined and claimed by their respective physical and/or functional attributes described herein in any combination without limitation. The breadth, specificity, and variation of the inventive subject matter are further illustrated by specific aspects summarized here.

One significant aspect of the inventive subject matter described herein is directed to the treatment of cardiovascular disease (CVD), which is the leading cause of death worldwide, responsible for nearly one in three deaths according to the World Health Organization. CVD is also a leading contributor to reductions in life expectancy and is one of the most expensive health conditions to care for. According to the Centers for Disease Control and Prevention (CDC), CVD is a significant economic burden, costing the U.S. healthcare system more than $320 billion per year in annual costs and lost productivity. CVD collectively refers to diseases of the heart and blood vessels, which are diagnosed as either atherosclerotic cardiovascular disease (ASCVD) or cardiomyopathy, among others. ASCVD is a large subset of CVD for which cholesterol drives the development of atherosclerotic plaque, a mixture of cholesterol, cells and cellular debris in the wall of a blood vessel that results in the hardening of the arteries. The current cornerstone of the treatment and prevention of ASCVD is to lower cumulative exposure to blood lipids aiming to maintain low-density lipoprotein cholesterol (LDL-C, commonly known as "bad" cholesterol) and/or triglycerides as low as possible for as long as possible. There is significant evidence, for example, demonstrating that individuals who maintain LDL-C at sufficiently low levels over a sufficiently long period of time are substantially less likely to develop ASCVD. The relationship between the lowering of LDL-C and reduction in ASCVD is amongst the best understood of all relationships in medicine. It has been shown that lowering LDL-C by 39 mg/dL for five years in a patient with established ASCVD reduces ASCVD risk by 21%, whereas that same 39 mg/dL degree of LDL-C reduction over a lifetime reduces risk of a first ASCVD event by 88%. The current standard of care is a chronic care model that typically requires numerous daily pills and/or intermittent injections and often insufficiently controls cumulative exposure to LDL-C. Despite the availability of such chronic care therapies, cumulative exposure to LDL-C is often insufficiently controlled in many patients with ASCVD, and a large fraction of individuals with established ASCVD have LDL-C levels above the recommend goal. Higher cumulative LDL-C exposure leads to accelerated cholesterol plaque build-up in the heart or neck arteries and the rupture of which can result in heart attack, cardiac death, stroke and the need for invasive medical procedures, such as intracoronary stenting and coronary artery bypass surgery.

One aspect, disclosed herein, are compositions and methods that are capable of safely and effectively editing gene targets expressed in the liver to durably lower LDL-C and/or triglycerides thereby treating CVD such as ASCVD.

Another aspect, disclosed herein, is the efficacy and safety of the gene editing compositions described herein when administered as a single-course or dose (once-and-done) therapy, in repeat or successive doses, and combination gene editing therapy doses. The efficacy and safety of the compositions described herein are shown in in vitro and in vivo studies described herein involving various cell and animal experiments including mouse and non-human primate experiments, and the results or performance of the compositions disclosed herein represented in those studies each constitute aspects of the invention.

Another aspect of the composition and methods disclosed herein relates to the location where the edit in the gene is made, including for example compositions and methods directed at editing a gene in the splice site.

Another aspect of the compositions and methods disclosed herein are the constituent guide RNAs (gRNAs) and base editors that comprise the compositions that are capable of precisely editing a gene at a single base pair without imparting double-stranded breaks in the target gene. The compositions and method of use of those gRNAs and base editors including nucleotide or mRNA sequences that express and encode the base editor constitute yet another aspect.

Another aspect, disclosed herein, are the lipid nanoparticle (LNPs) formulations that encapsulate the gRNA and base editor drug substances, the selection of an LNP, and the relative ratios between the various components of the drug substance compositions alone and as part of the LNP.

Another aspect, disclosed herein, is directed at the dosing of gene editing compositions, such as those described herein, and the impact of dosing and repeat dosing on efficacy and safety profile indicia.

Another aspect, disclosed herein, are that the compositions and methods of use include implementations that are designed to target or edit specific genes such PCSK9, ANGPTL3, APOC3, and/or Lp(a) and/or have an impact on the protein levels of proteins expressed by those genes.

In one aspect, provided herein is a composition for editing a gene target comprising: (i) a base editor fusion protein comprising a programmable DNA binding domain and a deaminase, or a mRNA encoding the same, (ii) a guide RNA comprising a tracr sequence that serves as a binding scaffold for the base editor fusion protein, and a spacer sequence that corresponds to a protospacer on a ANGPTL3 gene, wherein the guide RNA directs the base editor fusion protein to effect a nucleobase alteration in the ANGPTL3 gene in vivo when administered to a mammalian subject, wherein when the guide RNA and the mRNA is administered at a total amount of at least 0.5 mg/kg, the base alteration occurs in at least 35% of whole liver cells in the mammalian subject as measured by next generation sequencing or Sanger sequencing. In some embodiments, the mammalian subject is a cynomolgus monkey, wherein when the guide RNA and the mRNA is administered at a total amount of about 1 mg/kg, the base alteration occurs in at least 35% of whole liver cells in the cynomolgus monkey as measured by next generation sequencing or Sanger sequencing. In some embodiments, the mammalian subject is a cynomolgus monkey, wherein when the guide RNA and the mRNA is administered at a total amount of about 3 mg/kg, the base alteration occurs in at least 50% of whole liver cells in the cynomolgus monkey as measured by next generation sequencing or Sanger sequencing. In some embodiments, the nucleobase alteration results in a reduction of at least 20% in blood triglyceride level in the cynomolgus monkey as compared to prior to the administration. In some embodiments, the nucleobase alteration results in a reduction of at least 50% in blood triglyceride level in the cynomolgus monkey as compared to prior to the administration. In some embodiments, the protospacer is located in a splice site. In some embodiments, the protospacer complementary sequence is in the antisense strand of the ANGPTL3 gene. In some embodiments, the protospacer complementary sequence is in the sense strand of the ANGPTL3 gene. In some embodiments, the base alteration happens outside of the protospacer on the ANGPTL3 gene (off-target sites), wherein the editing percentages of off-target sites set forth in Table 14 are below or equal to the editing percentages set forth in Table 14, respectively. In some embodiments, the deaminase is an adenine deaminase and wherein the nucleobase alteration is a A·T to G·C alteration. In some embodiments, the programmable DNA binding domain comprises a nuclease inactive Cas9 or a Cas9 nickase. In some embodiments, the nucleobase alteration is at a splice site of the ANGPTL3 gene. In some embodiments, the nucleobase alteration is at a splice donor site of the ANGPTL3 gene. In some embodiments, the splice donor site is at 5' end of ANGPTL3 intron 6 as referenced in SEQ ID NO: 7. In some embodiments, the nucleobase alteration is at a splice acceptor site of the ANGPTL3 gene. In some embodiments, the nucleobase alteration results in a frame shift, a premature stop codon, an insertion or deletion in a transcript encoded by the ANGPTL3 gene. In some embodiments, the nucleobase alteration results in an aberrant transcript encoded by the ANGPTL3 gene. In some embodiments, the guide RNA is chemically modified. In some embodiments, the tracr sequence of the guide RNA is chemically modified following the scheme depicted in FIG. 7. In some embodiments, the spacer sequence comprises an ANGPTL3 ABE guide RNA spacer sequence set forth in Table 1. In some embodiments, the guide RNA comprises the ANGPTL3 ABE guide RNA sequence of GA067, GA091, GA098, GA099, GA100, GA101, GA102, GA103, GA347, GA441, GA442, GA472, GA473, GA474, GA475, GA476, GA517 or GA547 as set forth in Table 1. In some embodiments, the protospacer sequence comprises an ANGPTL3 ABE protospacer sequence set forth in Table 1. In some embodiments, the protospacer comprises the sequence 5'-AAGATACCT-GAATAACTCTC-3' (SEQ ID No: 14), 5'-AAGATACCT-GAATAACCCTC-3' (SEQ ID No: 15), 5'-GATACCT-GAATAACTCTC-3' (SEQ ID No: 1606), 5'-AGATACCTGAATAACCCTC-3' (SEQ ID No: 248), or 5'-GATACCTGAATAACCCTC-3' (SEQ ID No: 249). In some embodiments, the base editor fusion protein comprises an amino acid sequence of SEQ ID No: 2137. In some embodiments, the GC % content of the mRNA sequence is greater than 50%. In some embodiments, the GC % content of the mRNA sequence is greater than 56%. In some embodiments, the GC % content of the mRNA sequence is greater than or equal to 63%. In some embodiments, the mRNA comprises an adenine tTNA deaminase (TadA) region, a Cas9 region and a nuclear localization sequence (NLS) region. In some embodiments, the mRNA further comprises a first linker region which connects the TadA region and the Cas9 region, and a second linker region which connects the Cas9 region and the NLS region. In some embodiments, the GC % content of the TadA region is greater than 60%. In some embodiments, the GC % content of the TadA region is greater than or equal to 70%. In some embodiments, the GC % content of the Cas9 region is greater than 56%. In some embodiments, the GC % content of the Cas9 region is greater than or equal to 62%. In some embodiments, the GC % content of the NLS region is greater than 54%. In some embodiments, the GC % content of the NLS region is greater than or equal to 63%. In some embodiments, the GC % content of the first linker region is greater than 65%. In some embodiments, the GC % content of the first linker region is greater than or equal to 79%. In some embodiments, the GC % content of the second linker region is greater than 67%. In some embodiments, the GC % content of the second linker region is greater than or equal to 83%. In some embodiments, the GC % content of the TadA region is greater than 60%, the GC % content of the Cas9 region is greater than 56%, the GC % content of the NLS region is greater than 54%, the GC % content of the first linker region is greater than 65%, and the GC % content of the second linker region is greater than 67%. In some embodiments, the mRNA comprises a mRNA sequence selected from Table 23. In some embodiments, the mRNA comprises a mRNA sequence of SEQ ID No: 2136. In some embodiments, the mRNA comprises a poly A tail. In some embodiments, the composition further comprises a lipid nanoparticle (LNP) enclosing (i). In some embodiments, the LNP further encloses (ii). In some embodiments, the composition further comprises a second LNP enclosing (ii). In some embodiments, the ratio of the guide RNA and the mRNA encoding the base editor fusion protein is about 1:10 to about 10:1 by weight. In some embodiments, the ratio of the guide RNA and the mRNA encoding the base editor fusion protein is about 1:1, 1.5:1, 2:1, 3:1, 4:1, 1:1.5, 1:2, 1:3, or 1:4 by weight. In some embodiments, the ratio of the guide RNA and the mRNA encoding the base editor fusion protein is about 1:1 by weight.

In another aspect, provided herein is a pharmaceutical composition comprising the composition as provided herein and a pharmaceutically acceptable carrier or excipient.

In another aspect, provided herein is a method for treating or preventing a condition in a subject in need thereof, the method comprising administering to the subject a therapeutically effective amount of the composition as provided herein. In some embodiments, the administration is via intravenous infusion. In some embodiments, the method comprises sequential administration of a LNP enclosing (i) and a LNP enclosing (ii). In some embodiments, the method comprises concurrent administration of the LNP enclosing (i) and the LNP enclosing (ii). In some embodiments, the method comprises administering a single dose of the LNP enclosing (ii) followed by staggered doses of the LNP enclosing (i) over an interval of 1 day. In some embodiments, the method comprises administering a single dose of the LNP enclosing (ii) followed by staggered doses of the LNP enclosing (i) over an interval of 2 days. In some embodiments, the method comprises administering a single dose of the LNP enclosing (ii) followed by staggered doses of the LNP enclosing (i) over an interval of 3 days. In some embodiments, the method comprises administering a single dose of the LNP enclosing (ii) followed by staggered doses of the LNP enclosing (i) over an interval of 4 days. In some embodiments, the method comprises administering a single dose of the LNP enclosing (ii) followed by staggered doses of the LNP enclosing (i) over an interval of 5 days. In some embodiments, the method comprises administering a single dose of the LNP enclosing (ii) followed by staggered doses of the LNP enclosing (i) over an interval of 6 days. In some embodiments, the method comprises administering a single dose of the LNP enclosing (ii) followed by staggered doses of the LNP enclosing (i) over an interval of 7 days. In some embodiments, the method comprises administering a single dose of the LNP enclosing (i) and (ii). In some embodiments, the single dose of the LNP is at about 0.3 to about 3 mg/kg. In some embodiments, the method comprises administering a treatment course of one or more treatments to the subject, wherein each one of the one or more treatment comprises one or more of the single doses of the LNP. In some embodiments, the method comprises administering a treatment course of two to ten treatments. In some embodiments, the method comprises administering a treatment course of two to five treatments. In some embodiments, the method comprises administering a treatment course of two treatments. In some embodiments, the method comprises administering a treatment course of three treatments. In some embodiments, the method comprises administering a treatment course of four treatments. In some embodiments, the method comprises administering a treatment course of five treatments. In some embodiments, the method comprises the condition is an atherosclerotic cardiovascular disease. In some embodiments, the condition is an atherosclerotic vascular disease. In some embodiments, the subject is a human.

In another aspect, provided herein is a composition for editing a gene target comprising: (i) a base editor fusion protein comprising a programmable DNA binding domain and a deaminase, or a mRNA encoding the same, (ii) a guide RNA comprising a tracr sequence that serves as a binding scaffold for the base editor fusion protein, and a spacer sequence that corresponds to a protospacer on a ANGPTL3 gene, wherein the guide RNA directs the base editor fusion protein to effect a nucleobase alteration in the ANGPTL3 gene in vivo when administered to a mammalian subject, and wherein the guide RNA comprises the ANGPTL3 ABE guide RNA sequences as set forth in Table 1. In another aspect, provided herein is a composition for editing a gene target comprising: (i) a base editor fusion protein comprising a programmable DNA binding domain and a deaminase, or a mRNA encoding the same, (ii) a guide RNA comprising a tracr sequence that serves as a binding scaffold for the base editor fusion protein, and a spacer sequence that corresponds to a protospacer on a ANGPTL3 gene, wherein the guide RNA directs the base editor fusion protein to effect a nucleobase alteration in the ANGPTL3 gene in vivo when administered to a mammalian subject, and wherein the mRNA comprises a sequence selected from Table 23.

In another aspect, provided herein is a method for treating or preventing an atherosclerotic cardiovascular disease in a subject in need thereof, the method comprising administering to the subject a therapeutically effective amount of a first composition, comprising (i) a base editor fusion protein comprising a programmable DNA binding domain and a deaminase, or a mRNA encoding the same, (ii) a guide RNA comprising a tracr sequence that serves as a binding scaffold for the base editor fusion protein, and a spacer sequence that corresponds to a protospacer on a PCSK9 gene, wherein the guide RNA directs the base editor fusion protein to effect a nucleobase alteration in the PCSK9 gene in vivo when administered to a mammalian subject, wherein when the guide RNA and the mRNA is administered at a total amount of at least 0.5 mg/kg, the base alteration occurs in at least 35% of whole liver cells in the mammalian subject as measured by next generation sequencing or Sanger sequencing; and a second composition, comprising (i) a base editor fusion protein comprising a programmable DNA binding domain and a deaminase, or a mRNA encoding the same, (ii) a guide RNA comprising a tracr sequence that serves as a binding scaffold for the base editor fusion protein, and a spacer sequence that corresponds to a protospacer on a ANGPTL3 gene, wherein the guide RNA directs the base editor fusion protein to effect a nucleobase alteration in the ANGPTL3 gene in vivo when administered to a mammalian subject, wherein when the guide RNA and the mRNA is administered at a total amount of at least 1 mg/kg, the base alteration occurs in at least 35% of whole liver cells in the mammalian subject as measured by next generation sequencing or Sanger sequencing. In some embodiments, the method comprises sequential administration of the first composition and the second composition. In some embodiments, the method comprises administering one or more doses of the first composition followed by one or more dose of the second composition. In some embodiments, the method comprises administering one or more doses of the second composition followed by one or more dose of the first composition. In some embodiments, the method comprises concurrent administration of the first composition and the second composition. In some embodiments, the method comprises one or more doses of the first composition and the second composition.

In another aspect, provided herein is a composition for editing a gene target comprising: (i) a base editor fusion protein comprising a programmable DNA binding domain and a deaminase, or a mRNA encoding the same, (ii) a guide RNA comprising a tracr sequence that serves as a binding scaffold for the base editor fusion protein, and a spacer sequence that corresponds to a protospacer on a ANGPTL3 gene, wherein the guide RNA directs the base editor fusion protein to effect a nucleobase alteration in the ANGPTL3 gene in vitro, wherein when the guide RNA and the mRNA is administered at a total amount of at least 0.5 mg/kg, the base alteration occurs in at least 35% of whole liver cells in the mammalian subject as measured by next generation sequencing or Sanger sequencing. In some embodiments, when the guide RNA and the mRNA is administered at a total amount of at least 1 mg/kg, the base alteration occurs in at least 40% of whole liver cells in the mammalian subject as measured by next generation sequencing or Sanger sequencing. In some embodiments, when the guide RNA and the mRNA is administered at a total amount of at least 1.5 mg/kg, the base alteration occurs in at least 45% of whole liver cells in the mammalian subject as measured by next generation sequencing or Sanger sequencing. In some embodiments, when the guide RNA and the mRNA is administered at a total amount of at least 2 mg/kg, the base alteration occurs in at least 50% of whole liver cells in the mammalian subject as measured by next generation sequencing or Sanger sequencing. In some embodiments, when the guide RNA and the mRNA is administered at a total amount of at least 2.5 mg/kg, the base alteration occurs in at least 55% of whole liver cells in the mammalian subject as measured by next generation sequencing or Sanger sequencing. In some embodiments, when the guide RNA and the mRNA is administered at a total amount of at least 3 mg/kg, the base alteration occurs in at least 60% of whole liver cells in the mammalian subject as measured by next generation sequencing or Sanger sequencing.

In another aspect, provided herein is a composition for editing an ANGPTL3 gene comprising: (a) a mRNA encoding an adenine base editor protein having an editing window, and (b) a guide RNA comprising a tracr sequence that serves as a binding scaffold for the base editor protein and a spacer sequence that serves to guide the base editor protein to a protospacer sequence on the ANGPTL3 gene, wherein the spacer sequence is complimentary, at least in part, to a splice site or an exon region of the ANGPTL3 gene. In some embodiments, when the base editor protein is operatively bound to the guide RNA and the guide RNA is hybridized with the complementary strand to the protospacer sequence on the ANGPTL3 gene, the editing window encompasses the splice site of the ANGPTL3 gene. In some embodiments, when the base editor protein is operatively bound to the guide RNA and the guide RNA is hybridized with the complementary strand to the protospacer sequence on the ANGPTL3 gene, the editing window encompasses a region of an intron of the ANGPTL3 gene. In some embodiments, when the base editor protein is operatively bound to the guide RNA and the guide RNA is hybridized with the complementary strand to the protospacer sequence on the ANGPTL3 gene, the editing window encompasses a region of intron 1, intron 3 or intron 4 of the ANGPTL3 gene. In some embodiments, when the base editor protein is operatively bound to the guide RNA and the guide RNA is hybridized with the complementary strand to the protospacer sequence on the ANGPTL3 gene, the editing window encompasses a region of intron 1 of the ANGPTL3 gene. In some embodiments, the spacer sequence has a 80-100% nucleotide sequence identity to a spacer sequence selected from the group of guide RNA sequences identified as GA067, GA100 and GA574. In some embodiments, the tracr sequence has a 80-100% nucleotide sequence identity to a tracr sequence selected from the group of guide RNA sequences identified as GA067, GA091, GA098, GA099, GA100, GA101, GA102, GA103, GA347, GA441, GA442, GA472, GA473, GA474, GA475, GA476, GA517 and GA547. In some embodiments, the mRNA has an 80-100% sequence identity to the mRNA sequences identified as MA002, MA004, MA040, MA0041, or MA045. In some embodiments, the mRNA has one or more of the GC nucleotide region percentages set forth in the following table:

| Nucleotide region | Average GC Nucleotide Content |
|---|---|
| 27-213 | 67-73% |
| 389-661 | 67-71% |
| 735-829 | 63-74% |
| 4207-4286 | 67-70% |
| 4537-4569 | 65-73% |
| 4683-4741 | 62-67% |

In some embodiments, the mRNA as one or more o the GC nucleotide region percentages set forth in the following table:

| Nucleotide region | Average GC Nucleotide Content |
|---|---|
| 27-213 | At least 73% |
| 389-661 | At least 71% |
| 735-829 | At least 74% |
| 4207-4286 | At least 70% |
| 4537-4569 | At least 73% |
| 4683-4741 | At least 67% |

In some embodiments, the mRNA and gRNA are encapsulated within a lipid nanoparticle. In some embodiments, the mRNA and gRNA are encapsulated within a lipid nanoparticle having the following:
LNP composition (mol %):
  40-65% iLipid
  2-20% DSPC
  1-5% PEG
  Remaining mol % balance is cholesterol;
  LNP Particle size: 55-120 nm Z average hydrodynamic diameter; and
  Polydispersity index of <0.2 as determined by dynamic light scattering.

In some embodiments, the mRNA and gRNA are encapsulated within the lipid nanoparticle having an LNP particle size between 50-70 nm Z average hydrodynamic diameter. In some embodiments, the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 40 percent. In some embodiments, the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 50 percent. In some embodiments, the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 30 percent. In some embodiments, the composition when administered to a group of cynomolgus monkeys via intravenous infusion at a dose of approximately 1 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 40 percent. In some embodiments, the composition when administered to a group of cynomolgus monkeys via intravenous infusion at a dose of approximately 1 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 50 percent. In some embodiments, the composition when administered to a group of cynomolgus monkeys via intravenous infusion at a dose of approximately 1 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 60 percent. In some embodiments, the composition when administered to a group of cynomolgus monkeys via intravenous infusion at a dose of approximately 1 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 70 percent. In some embodiments, the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 40 percent. In some embodiments, the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 50 percent. In some embodiments, the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 60 percent. In some embodiments, the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 70 percent. In some embodiments, the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 80 percent. In some embodiments, the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 40 percent. In some embodiments, the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 50 percent. In some embodiments, the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 60 percent. In some embodiments, the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 70 percent. In some embodiments, the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 80 percent. In some embodiments, the percent editing is determined at 15 days after dosing through analysis of dosed cynomolgus monkey liver either via liver biopsy or necropsy of the monkey. In some embodiments, the percent editing is determined to be durably maintained by periodic liver biopsy testing of the dosed cynomolgus monkeys over a span of at least 168 days after dosing. In some embodiments, the percent editing is determined to be durably maintained by periodic liver biopsy testing of the dosed cynomolgus monkeys over a span of at least 300 days after dosing. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed cynomolgus monkeys on average of at least 35 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed cynomolgus monkeys on average of at least 40 percent as compared to baseline. In some embodiments, the composition when administered to a group of cynomolgus monkeys via intravenous infusion at a dose of approximately 0.5 mg of the guide RNA and mRNA combined total weight per kg of monkey weight is capable of reducing ANGPTL3 protein in the plasma of the dosed cynomolgus monkeys on average of at least 50 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed monkeys on average of at least 60 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed cynomolgus monkeys on average of at least 70 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed cynomolgus monkeys on average of at least 80 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 35 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 40 percent as compared to baseline. In some embodiments, the composition when administered to a group of cynomolgus monkeys via intravenous infusion at a dose of approximately 1 mg of the guide RNA and mRNA combined total weight per kg of monkey weight is capable of reducing ANGPTL3 protein in the plasma of the dosed cynomolgus monkeys on average of at least 50 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 60 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 70 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 80 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 35 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 40 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 50 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 60 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 70 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 80 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 35 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 40 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 50 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 60 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 70 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 80 percent as compared to baseline. In some embodiments, the reduction in plasma protein is determined at 15 days after dosing via blood sampling and analysis of the dosed cynomolgus monkey. In some embodiments, the composition when administered to a group of cynomolgus monkeys via intravenous infusion at a dose of approximately 0.5 mg of the guide RNA and mRNA combined total weight per kg of monkey weight is capable of reducing triglyceride level in the plasma of the dosed monkeys on average of at least 20 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 25 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 30 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 35 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 40 percent as compared to baseline. In some embodiments, the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 45 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 20 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 25 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 30 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 35 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 40 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 45 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 50 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 55 percent as compared to baseline. In some embodiments, the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 60 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 20 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 25 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 30 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 35 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 40 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 45 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 50 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 55 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 60 percent as compared to baseline. In some embodiments, the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 65 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 20 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 25 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 30 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 35 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 40 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 45 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 50 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 55 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 60 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 65 percent as compared to baseline. In some embodiments, the reduction in triglyceride level is determined at 15 days after dosing via blood sampling and analysis of the dosed cynomolgus monkey. In some embodiments, the reduction in triglyceride level is determined to be durably maintained over a span of at least 168 days by periodic blood sampling and analysis of the dosed cynomolgus monkey. In some embodiments, the reduction in triglyceride level is determined to be durably maintained over a span of at least 300 days by periodic blood sampling and analysis of the dosed cynomolgus monkey. In some embodiments, the composition when administered to a group of cynomolgus monkeys via intravenous infusion at a dose of approximately 3 mg of the guide RNA and mRNA combined total weight per kg of cynomolgus monkey weight is capable of reducing lipoprotein(a) in the plasma of the dosed cynomolgus monkeys on average of at least 10 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 15 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 20 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 25 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 30 percent as compared to baseline. In some embodiments, the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of approximately 35 percent as compared to baseline. In some embodiments, the reduction in lipoprotein(a) is determined at 15 days after dosing via blood sampling and analysis of the dosed cynomolgus monkey. In some embodiments, the reduction in lipoprotein(a) is determined to be durably maintained over a span of at least 224 days by periodic blood sampling and analysis of the dosed cynomolgus monkey. In some embodiments, the reduction in lipoprotein(a) is determined to be durably maintained over a span of at least 300 days by periodic blood sampling and analysis of the dosed cynomolgus monkey. In some embodiments, to the extent that the dosing of the cynomolgus monkeys results in elevation of AST, ALT, or Cytokines, the elevations resulting from the dosing of the composition are transient and resolved back to approximately baseline levels within 3-15 days after dosing. In some embodiments, the percent editing of ANGPTL3 is negligible outside of the liver, spleen and adrenal glands tissues as illustrated in FIG. 27. In some embodiments, repeat dosing results is additive with respect to the editing percentage of ANGPTL3 editing percentage. In some embodiments, the repeat dosing does not elicit cytokine activation nor an immune response. In some embodiments, the spacer sequence has at least 80% nucleotide correlation with the nucleotide sequence of a targeted protospacer on the ANGPTL3 gene, wherein an RNA nucleotide on the spacer sequence is in correlation with a DNA nucleotide of the protospacer if it has the same nucleotide as the DNA nucleotide in the same order and wherein uracil and thymine bases are considered the same nucleotide for purposes of determining correlation. In some embodiments, the spacer sequence has at least 85% nucleotide correlation with the nucleotide sequence of a targeted protospacer on the ANGPTL3 gene. In some embodiments, the spacer sequence has at least 90% nucleotide correlation with the nucleotide sequence of a targeted protospacer on the ANGPTL3 gene. In some embodiments, the spacer sequence has at least 95% nucleotide correlation with the nucleotide sequence of a targeted protospacer on the ANGPTL3 gene. In some embodiments, the spacer sequence has at least 99% nucleotide correlation with the nucleotide sequence of a targeted protospacer on the ANGPTL3 gene. In some embodiments, the spacer sequence has at least 100% nucleotide correlation with the nucleotide sequence of a targeted protospacer on the ANGPTL3 gene.

In another aspect, provided herein is a method for treating or preventing an atherosclerotic cardiovascular disease in a subject in need thereof, the method comprising administering to the subject a therapeutically effective amount of (a) a mRNA encoding an adenine base editor protein having an editing window, (b) a first guide RNA comprising a tracr sequence that serves as a binding scaffold for the base editor protein and a spacer sequence that serves to guide the base editor protein to a protospacer sequence on a PCSK9 gene, wherein the spacer sequence is complimentary, at least in part, to a splice site or an exon region of the PCSK9 gene; and (c) a second guide RNA comprising a tracr sequence that serves as a binding scaffold for the base editor protein and a spacer sequence that serves to guide the base editor protein to a protospacer sequence on a ANGPTL3 gene, wherein the spacer sequence is complimentary, at least in part, to a splice site or an exon region of the ANGPTL3 gene. In some embodiments, the method further comprises a first LNP enclosing (a). In some embodiments, the first LNP encloses (b) and (c). In some embodiments, the first LNP was administered repeatedly. In some embodiments, the first LNP was administered repeatedly at an interval of one to sixty days. In some embodiments, the first LNP was administered repeatedly at an interval of seven days. In some embodiments, the first LNP further encloses (b). In some embodiments, the method further comprises a second LNP enclosing (a) and (c). In some embodiments, the first LNP and the second LNP are administered sequentially. In some embodiments, the first LNP and the second LNP are administered sequentially at an interval of one day to 12 months. In some embodiments, the interval is one day. In some embodiments, the interval is five days. In some embodiments, the interval is ten days. In some embodiments, the interval is fifteen days. In some embodiments, the interval is twenty days. In some embodiments, the interval is twenty-five days. In some embodiments, the interval is one month. In some embodiments, the interval is two months. In some embodiments, the interval is three months. In some embodiments, the interval is five months. In some embodiments, the interval is eight months. In some embodiments, the interval is ten months. In some embodiments, the interval is twelve months.

BRIEF DESCRIPTION OF THE DRAWINGS

The features, principles, advantages, and illustrative embodiments, implementations, analysis, and examples of the subject matter of this application are set forth herein including in the appended claims with aspects of which being illustrated in the accompanying drawings of which:

FIG. 1D discloses SEQ ID NOS 70-71, respectively, in order of appearance.

FIG. 2 are two tables that describe how SpCas9 crystal structures were chosen in connection with designing a gRNAs disclosed herein based on structure. The top panel is a table summarizing different components of CRISPR/Cas system with Protein Data Bank (PDB) IDs and the state. The bottom panel shows the root mean square deviation (RMSD) values after alignment between the protein chains of each structure. The RNP state (4ZT0) and pre-catalytic ternary complex (5F9R) are the most relevant to determine contacts related to RNP formation and contacts related to catalysis. Some rearrangement of the protein occurs between these two states. Massive rearrangements may occur in the protein between the apo state and the RNP.

FIG. 7B depicts the sequence alignment of unmodified SEQ ID NO: 61, a reference tracrRNA sequence ("Lit Tracr"), tracr1, tracr2, and tracr3. (SEQ ID NO: 73)

FIG. 9 discloses SEQ ID NO: 75.

FIG. 10 discloses SEQ ID NO: 76.

FIG. 11 discloses SEQ ID NO 77-79, respectively in order of appearance.

FIG. 16 shows gene editing of Pcsk9 in mice (n=2-5 mice) via LNPs containing SpCas9 mRNA MS002 (TriLink Biotechnologies) and mouse Pcsk9-targeting gRNA with different tracr designs (GA052, GA053, GA054, and GA055) at a 1:1 weight ratio. Wild-type C57BL/6 mice were dosed with 2 mg/kg of the LNP test article. The mg/kg dose was calculated based on total RNA and the total RNA is the quantified sum of mRNA and gRNA present in the LNP after formulation. Seven days after dosing, the mice were euthanized and genomic DNA was harvested from mouse liver, and then assessed for base editing of the target site with next-generation sequencing. All four guide RNAs evaluated carry same spacer and same pattern of chemical modification within the first 20 nucleotides from the 5'-end, but all four differ in chemical modification pattern within the tracr between nucleotides at position 21 and at position 100 of the 100-mer guide RNA.

FIG. 25A depicts editing of the PCSK9 exon 1 splice-donor adenine base in the livers of cynomolgus monkeys receiving an intravenous infusion of a 1 mg/kg dose of an LNP formulation with ABE8.8 mRNA MA004 and PCSK9 gRNA GA097 with necropsy at either 2 weeks (three animals) or 24 hours (two animals) following treatment. For each animal, editing was assessed in samples collected from sites distributed throughout the liver (n=8 samples; bar indicates mean editing in animal). Reduction of the blood PCSK9 protein level (FIG. 25B) or blood LDL-C level (FIG. 25C) in the three animals that underwent necropsy at 2 weeks following treatment are shown, comparing the level at 2 weeks versus the baseline pre-treatment level (n=1 blood sample per animal).

FIG. 26A depicts editing of the PCSK9 exon 1 splice-donor adenine base in the livers of cynomolgus monkeys receiving an intravenous infusion of 0.5, 1.0, or 1.5 mg/kg dose of an LNP formulation with ABE8.8 mRNA MA004 and PCSK9 gRNA GA346. Reduction of the blood PCSK9 protein level (FIG. 26B) or blood LDL-C level (FIG. 26C) for the animals are shown.

FIG. 28 illustrates editing of the PCSK9 exon 1 splice-donor adenine base editing in the livers of cynomolgus monkeys following intravenous infusions of individual lipid nanoparticles (LNPs) constituted with ABE mRNA MA004 and different guide RNAs with same spacer but with different tracer modifications. The guide RNAs used in this study were GA066, GA096, GA097 and GA346. The gRNA GA097 from two different sources were used in the same study and the sources are identified as (1) and (2). For tracr comparison studies the LNPS were dosed at 1 mg/kg total RNA dose where the guide RNA and mRNA were mixed at 1:1 weight ratio. The GA066 with published tracr design (Cell Reports, 2018 22, 2227-2235) produced lower base editing in monkey compared to all other tracr designs (FIG. 7)—GA095, GA097, and GA346— under same experimental conditions.

FIG. 38 discloses SEQ ID NO: 80, 2193-2196, 566, 2197-2205, 675, 2206-2220, 564, 2221-224, 638, 644, 506, 621, 2225-2226, 681, and 2227-2230, respectively, in order of appearance.

FIG. 51 shows the results from gene editing of ANGPTL3 or PCSK9 in non-human primates. Cynomolgus monkeys received an intravenous infusion of a 1.5 mg/kg dose of an LNP formulation with SpCas9 mRNA MS004 and one gRNA targeting either ANGPTL3 (GA261-GA263) or PCSK9 (GA266-GA271). Upon necropsy after 2 weeks, two pieces from each liver lobe (8 pieces total) were isolated and gDNA was extracted. Samples were processed as described in the detailed methods section. Indel % was analyzed for each separate piece and are graphed as individual points. High editing efficiency was observed in most NHP livers.

FIG. 52 shows the reduction of LDL-C from gene editing of ANGPTL3 or PCSK9 in non-human primates. Cynomolgus monkeys received an intravenous infusion of a 1.5 mg/kg dose of an LNP formulation with SpCas9 mRNA MS004 and one gRNA targeting either ANGPTL3 (GA261-GA263) or PCSK9 (GA266-GA271). Samples were processed as described in the detailed methods section. All NHPs that received LNPs with SpCas9 mRNA/PCSK9 gRNA had at least 35% reduction in circulating LDL-C levels. Although more modest, LNPs with SpCas9 mRNA/ANGPTL3 gRNA had 10-25% reduction in circulating LDL-C levels.

FIG. 53 shows the triglyceride levels from gene editing of ANGPTL3 or PCSK9 in non-human primates. Cynomolgus monkeys received an intravenous infusion of a 1.5 mg/kg dose of an LNP formulation with SpCas9 mRNA MS004 and one gRNA targeting either ANGPTL3 (GA261-GA263) or PCSK9 (GA266-GA271). Samples were processed as described in the detailed methods section. NHPs that received LNPs with SpCas9 mRNA/ANGPTL3 gRNA had around 10-50% reduction in triglyceride levels. NHPs that received LNPs with SpCas9 mRNA/PCSK9 gRNA did not show a significant reduction in triglyceride levels.

DETAILED DESCRIPTION

Figure 1A:
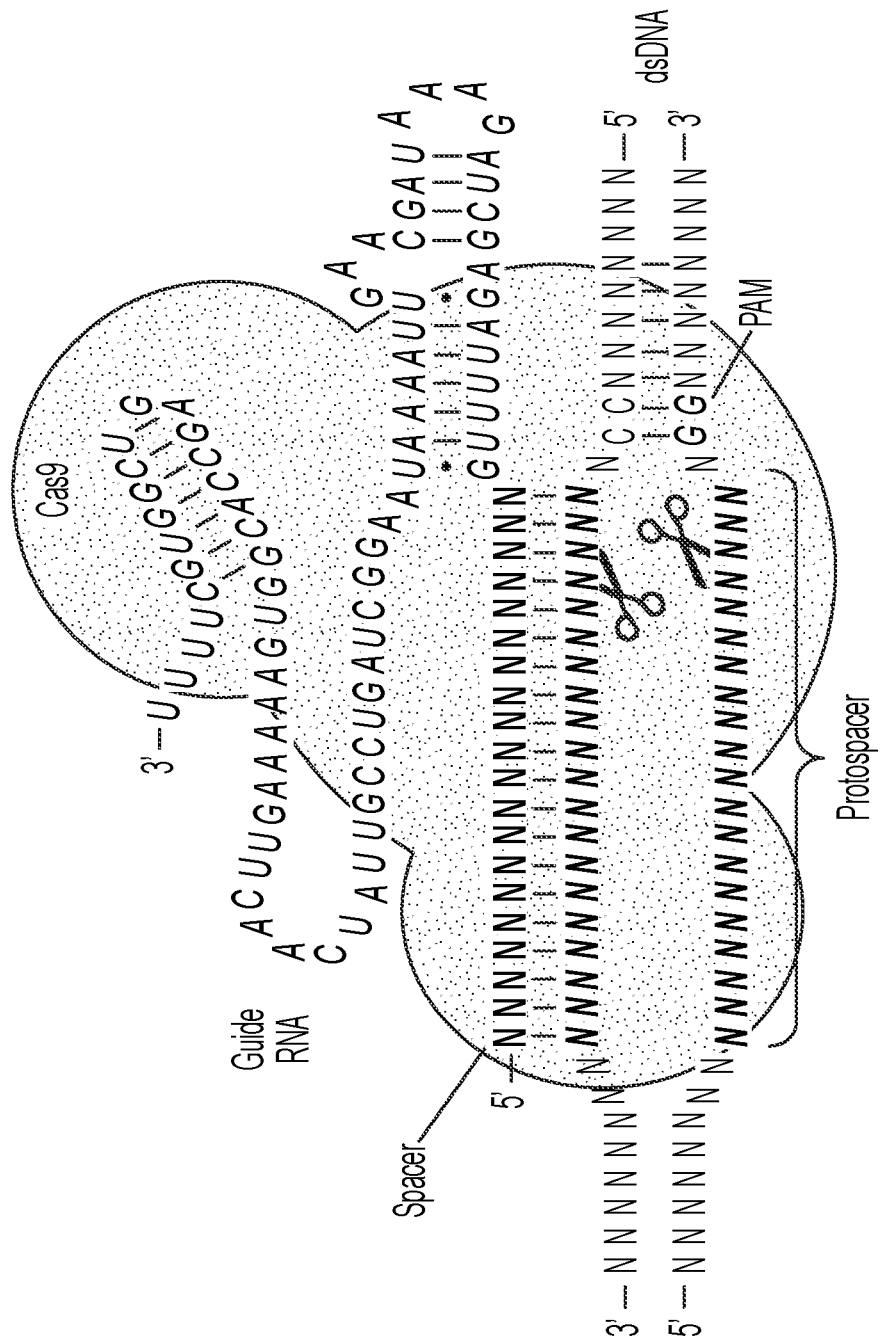
FIGS. 1A-IC illustrate the modes of operation of Cas9, cytidine base editors (CBE), and adenine base editors (ABE) respectively, along with relevant terminology used in this application including "protospacer", "PAM", "spacer" (Mali, P et al 2013 *Nat Methods* 10, 957-963; Anzalone, A V. 2020 *Nat Biotechnol* 38, 824-844).

Certain specific details of this description are set forth in order to provide a thorough understanding of various embodiments. However, one skilled in the art will understand that the present disclosure may be practiced without these details. In other instances, well-known structures have not been shown or described in detail to avoid unnecessarily obscuring descriptions of the embodiments.

Unless otherwise defined, all technical and scientific terms used herein have the same meaning as commonly understood by one of ordinary skill in the art to which this disclosure belongs. Although methods and materials similar or equivalent to those described herein can be used in the practice or testing of the present disclosure, suitable methods, and materials are described below. Further, headings provided herein are for convenience only and do not interpret the scope or meaning of the claimed disclosure. It is contemplated that any embodiment discussed in this specification can be implemented with respect to any method or composition of the present disclosure, and vice versa. Furthermore, compositions of the present disclosure can be used to achieve methods of the present disclosure.

Definitions

To facilitate an understanding of the present disclosure, a number of terms and phrases are defined below.

As used in this specification and the appended claims, the singular forms "a," "an," and "the" include plural referents unless the content clearly dictates otherwise.

It should also be noted that the term "or" is generally employed in its sense including "and/or" unless the content clearly dictates otherwise. The terms "and/or" and "any combination thereof" and their grammatical equivalents as used herein, can be used interchangeably. These terms can convey that any combination is specifically contemplated.

Solely for illustrative purposes, the following phrases "A, B, and/or C" or "A, B, C, or any combination thereof" can mean "A individually; B individually; C individually; A and B; B and C; A and C; and A, B, and C." The term "or" can be used conjunctively or disjunctively, unless the context specifically refers to a disjunctive use.

The term "about" or "approximately" can mean within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, within 5-fold, and more preferably within 2-fold, of a value. Where particular values are described in the application and claims, unless otherwise stated the term "about" meaning within an acceptable error range for the particular value should be assumed.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps.

As used herein, "some embodiments," "an embodiment," "one embodiment," "embodiments" or "other embodiments" means that a particular feature, structure, or characteristic described in connection with the embodiments is included in at least some embodiments, but not necessarily all embodiments, of the present disclosures.

The term "nucleic acid" as used herein refers to a polymer containing at least two nucleotides (i.e., deoxyribonucleotides or ribonucleotides) in either single- or double-stranded form and includes DNA and RNA. "Nucleotides" contain a sugar deoxyribose (DNA) or ribose (RNA), a base, and a phosphate group. Nucleotides are linked together through the phosphate groups. "Bases" include purines and pyrimidines, which further include natural compounds adenine, thymine, guanine, cytosine, uracil, inosine, and natural analogs, and synthetic derivatives of purines and pyrimidines, which include, but are not limited to, modifications which place new reactive groups such as, but not limited to, amines, alcohols, thiols, carboxylates, and alkylhalides. A nucleic acid includes any oligonucleotide or polynucleotide, with fragments containing up to 60 nucleotides generally termed oligonucleotides, and longer fragments termed polynucleotides. A deoxyribooligonucleotide consists of a 5-carbon sugar called deoxyribose joined covalently to phosphate at the 5' and 3' carbons of this sugar to form an alternating, unbranched polymer. DNA may be in the form of, e.g., antisense molecules, plasmid DNA, pre-condensed DNA, a PCR product, vectors, expression cassettes, chimeric sequences, chromosomal DNA, or derivatives and combinations of these groups. A ribooligonucleotide consists of a similar repeating structure where the 5-carbon sugar is ribose. Accordingly, the terms "polynucleotide" and "oligonucleotide" can refer to a polymer or oligomer of nucleotide or nucleoside monomers consisting of naturally-occurring bases, sugars and inter-sugar (backbone) linkages. Additionally, nucleic acids include nucleic acids containing known nucleotide analogs or modified backbone residues or linkages, which are synthetic, nonstandard, and/or non-naturally occurring, and which have similar binding properties as the reference nucleic acid. The nucleic acid may be modified at the base moiety (e.g., at one or more atoms that typically are available to form a hydrogen bond with a complementary nucleotide and/or at one or more atoms that are not typically capable of forming a hydrogen bond with a complementary nucleotide), sugar moiety, or phosphate backbone. Backbone modifications can include, but are not limited to, a phosphorothioate, a phosphorodithioate, a phosphoroselenoate, a phosphorodiselenoate, a phosphoroanilothioate, a phosphoraniladate, a phosphoramidate, and a phosphorodiamidate linkage. A phosphorothioate linkage substitutes a sulfur atom for a non-bridging oxygen in the phosphate backbone and delays nuclease degradation of oligonucleotides. A phosphorodiamidate linkage (N3'→P5') allows preventing nuclease recognition and degradation. Backbone modifications can also include having peptide bonds instead of phosphorous in the backbone structure (e.g., N-(2-aminoethyl)-glycine units linked by peptide bonds in a peptide nucleic acid), or linking groups including carbamate, amides, and linear and cyclic hydrocarbon groups. Oligonucleotides with modified backbones are reviewed in Micklefield, Backbone modification of nucleic acids: synthesis, structure and therapeutic applications, Curr. Med. Chem., 8 (10): 1157-79, 2001 and Lyer et al., Modified oligonucleotides-synthesis, properties and applications, Curr. Opin. Mol. Ther., 1 (3): 344-358, 1999. Nucleic acid molecules described herein may contain a sugar moiety that comprises ribose or deoxyribose, as present in naturally occurring nucleotides, or a modified sugar moiety or sugar analog. The examples of modified sugar moieties include, but are not limited to, 2'-O-methyl, 2'-O-methoxyethyl, 2'-O-aminoethyl, 2'-Flouro, N3'-P5' phosphoramidate, 2'dimethylaminooxyethoxy, 2' 2'dimethylaminoethoxyethoxy, 2'-guanidinidium, 2'-O-guanidinium ethyl, carbamate modified sugars, and bicyclic modified sugars. 2'-O-methyl or 2'-O-methoxyethyl modifications promote the A-form or RNA-like conformation in oligonucleotides, increase binding affinity to RNA, and have enhanced nuclease resistance. Modified sugar moieties can also include having an extra bridge bond (e.g., a methylene bridge joining the 2'-0 and 4'-C atoms of the ribose in a locked nucleic acid) or sugar analog such as a morpholine ring (e.g., as in a phosphorodiamidate morpholino). Examples of such analogs and/or modified residues include, but are not limited to diaminopurine, 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, 5-methyl-2-thiouracil, 3-(3-amino-3-N-2-carboxypropyl) uracil, (acp3)w, 2,6-diaminopurine, methyl phosphonates, chiral-methyl phosphonates, 2'-O-methyl ribonucleotides, peptide-nucleic acids (PNAs), and the like. In some cases, nucleotides may include modifications in their phosphate moieties, including modifications to a triphosphate moiety. Non-limiting examples of such modifications include phosphate chains of greater length (e.g., a phosphate chain having, 4, 5, 6, 7, 8, 9, 10 or more phosphate moieties) and modifications with thiol moieties (e.g., alpha-thiotriphosphate and beta-thiotriphosphates). Such modified or substituted oligonucleotides are often preferred over native forms because of properties such as, for example, enhanced cellular uptake, reduced immunogenicity, and increased stability in the presence of nucleases. Thus, the terms "polynucleotide" and "oligonucleotide" can also include polymers or oligomers comprising non-naturally occurring monomers, or portions thereof, which function similarly.

Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res., 19:5081 (1991); Ohtsuka et al., J. Biol. Chem., 260: 2605-2608 (1985); Rossolini et al., Mol. Cell. Probes, 8:91-98 (1994)).

The present disclosure encompasses isolated or substantially purified nucleic acid molecules and compositions containing those molecules. As used herein, an "isolated" or "purified" DNA molecule or RNA molecule is a DNA molecule or RNA molecule that exists apart from its native environment. An isolated DNA molecule or RNA molecule may exist in a purified form or may exist in a non-native environment such as, for example, a transgenic host cell. For example, an "isolated" or "purified" nucleic acid molecule or biologically active portion thereof, is substantially free of other cellular material, or culture medium when produced by recombinant techniques, or substantially free of chemical precursors or other chemicals when chemically synthesized. In one embodiment, an "isolated" nucleic acid is free of sequences that naturally flank the nucleic acid (i.e., sequences located at the 5' and 3' ends of the nucleic acid) in the genomic DNA of the organism from which the nucleic acid is derived. For example, in some embodiments, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived.

The term "vector," as used herein, refers to a nucleic acid molecule capable of transporting another nucleic acid to which it has been linked. In some examples, a vector is an expression vector that is capable of directing the expression of nucleic acids to which they are operatively linked. The term "operably linked," as used herein, means that the nucleotide sequence of interest is linked to regulatory sequence(s) in a manner that allows for expression of the nucleotide sequence. The term "regulatory sequence," as used herein, includes, but is not limited to promoters, enhancers and other expression control elements. Such regulatory sequences are well known in the art and are described, for example, in Goeddel; Gene Expression Technology: Methods in Enzymology 185, Academic Press, San Diego, CA (1990). Examples of expression vectors include, but are not limited to, plasmid vectors, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors.

As used herein, the terms "protein," "polypeptide," and "peptide" are used interchangeably and refer to a polymer of amino acid residues linked via peptide bonds and which may be composed of two or more polypeptide chains. The terms "polypeptide," "protein," and "peptide" refer to a polymer of at least two amino acid monomers joined together through amide bonds. An amino acid may be the L-optical isomer or the D-optical isomer. More specifically, the terms "polypeptide," "protein," and "peptide" refer to a molecule composed of two or more amino acids in a specific order; for example, the order as determined by the base sequence of nucleotides in the gene or RNA coding for the protein.

Proteins are essential for the structure, function, and regulation of the body's cells, tissues, and organs, and each protein has unique functions. Examples are hormones, enzymes, antibodies, and any fragments thereof. In some cases, a protein can be a portion of the protein, for example, a domain, a subdomain, or a motif of the protein. In some cases, a protein can be a variant (or mutation) of the protein, wherein one or more amino acid residues are inserted into, deleted from, and/or substituted into the naturally occurring (or at least a known) amino acid sequence of the protein. A protein or a variant thereof can be naturally occurring or recombinant. Methods for detection and/or measurement of polypeptides in biological material are well known in the art and include, but are not limited to, Western-blotting, flow cytometry, ELISAs, RIAs, and various proteomics techniques. An exemplary method to measure or detect a polypeptide is an immunoassay, such as an ELISA. This type of protein quantitation can be based on an antibody capable of capturing a specific antigen, and a second antibody capable of detecting the captured antigen. Exemplary assays for detection and/or measurement of polypeptides are described in Harlow, E. and Lane, D. Antibodies: A Laboratory Manual, (1988), Cold Spring Harbor Laboratory Press.

The term "sequence identity," as used herein, refers to the amount of nucleotide which match exactly between two different sequences. When comparing RNA and DNA sequences Uracil and Thymine bases are considered to be the same base. Gaps are not counted and the measurement is typically in relation to the shorter of the two sequences.

For example:
A: AAGGCTT
B: AAGGC
C: AAGGCAT

Here identity (A,B)=100% (5 identical nucleotides/min (length(A), length(B))).

Identity(B,C)=100%, but identity(A,C)=85% ((6 identical nucleotides/7). So 100% identity does not mean two sequences are the same.

The term "sequence similarity," as used herein, can be described as an optimal matching problem that finds the minimal number of edit operations (inserts, deletes, and substitutions) in order to transform the one sequence into an exact copy of the other sequence being aligned (edit distance). Using this, the percentage sequence similarity of the examples above are sim(A,B)=60%, sim(B,C)=60%, sim(A,C)=86% (semi-global, sim=1−(edit distance/unaligned length of the shorter sequence)).

A "subject" in need thereof, refers to an individual who has a disease, a symptom of the disease, or a predisposition toward the disease, with the purpose to cure, heal, alleviate, relieve, alter, remedy, ameliorate, improve, or affect the disease, the symptom of the disease, or the predisposition toward the disease. In some embodiments, the subject has hypercholesterolemia. In some embodiments, the subject has atherosclerotic vascular disease.

In some embodiments, the subject has hypertriglyceridemia. In some embodiments, the subject has diabetes. The term "subject" or "patient" encompasses mammals. Examples of mammals include, but are not limited to, any member of the mammalian class: humans, non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like.

The term "condition," as used herein, includes diseases, disorders, and susceptibilities. In some embodiments, the condition is an atherosclerotic vascular disease. In some embodiments, the condition is a hypertriglyceridemia. In some embodiments, the condition is a diabetes.

The term "atherosclerosis" or "atherosclerotic vascular disease," as used herein, refers to a disease in which the inside of an artery narrows due to the buildup of plaque. In some embodiments, it may result in coronary artery disease, stroke, peripheral artery disease, or kidney problems.

The term "hypertriglyceridemia," as used herein, refers to high (hyper-) blood levels (-emia) of triglycerides, the most abundant fatty molecule in most organisms. In some embodiments, elevated levels of triglycerides are associated with atherosclerosis, even in the absence of hypercholesterolemia (high cholesterol levels), and predispose to cardiovascular disease. In some embodiments, very high triglyceride levels increase the risk of acute pancreatitis. In some embodiments, hypertriglyceridemia is associated with overeating, obesity, diabetes mellitus and insulin resistance, excess alcohol consumption, kidney failure, nephrotic syndrome, genetic predisposition (e.g., familial combined hyperlipidemia, i.e., Type II hyperlipidemia), lipoprotein lipase deficiency, lysosomal acid lipase deficiency, cholesteryl ester storage disease, certain medications (e.g., isotretinoin, hydrochlorothiazide diuretics, beta blockers, protease inhibitors), hypothyroidism (underactive thyroid), systemic lupus erythematosus and associated autoimmune responses, glycogen storage disease type 1, propofol, or HIV medications.

The term "diabetes," as used herein, refers to a group of metabolic disorders characterized by a high blood sugar level over a prolonged period of time. In some embodiments, diabetes is type 1 diabetes that results from the pancreas's failure to produce enough insulin due to loss of beta cells. In some embodiments, diabetes is type 2 diabetes characterized by insulin resistance, a condition in which cells fail to respond to insulin properly. In some embodiments, diabetes is gestational diabetes that occurs when pregnant women without a previous history of diabetes develop high blood sugar levels.

The term "low-density lipoprotein (LDL)," as used herein, refers to a microscopic blob made up of an outer rim of lipoprotein and a cholesterol center. In some embodiments, LDL has a highly hydrophobic core composed of a polyunsaturated fatty acid known as linoleate and hundreds to thousands esterified and unesterified cholesterol molecules. In some embodiments, the core of LDL also carries triglycerides and other fats and is surrounded by a shell of phospholipids and unesterified cholesterol.

The term "high-density lipoprotein (HDL)," as used herein, refers to the smallest lipoprotein particles. In embodiments, plasma enzyme lecithin-cholesterol acyltransferase (LCAT) converts the free cholesterol into cholesteryl, which is then sequestered into the core of the lipoprotein particle, eventually causing the newly synthesized HDL to assume a spherical shape. In embodiments, HDL particles increase in size as they circulate through the bloodstream and incorporate more cholesterol and phospholipid molecules from cells and other lipoproteins.

The term "cholesterol," as used herein, refers to a lipid with a unique structure composed of four linked hydrocarbon rings forming the bulky steroid structure. The term "triglyceride," as used herein, refers to a tri-ester composed of a glycerol bound to three fatty acid molecules. In some embodiments, the fatty acids are saturated or unsaturated fatty acids.

The terms "treat," "treating," or "treatment," and its grammatical equivalents as used herein, can include alleviating, abating, or ameliorating at least one symptom of a disease or a condition, preventing additional symptoms, inhibiting the disease or the condition, e.g., delaying, decreasing, suppressing, attenuating, diminishing, arresting, or stabilizing the development or progression of a disease or the condition, relieving the disease or the condition, causing regression of the disease or the condition, relieving a condition caused by the disease or the condition, reducing disease severity, or stopping the symptoms of the disease or the condition either prophylactically and/or therapeutically. "Treating" also includes lessening the frequency of occurrence or recurrence, or the severity, of any symptoms or other ill effects related to a disease or condition and/or the side effects associated with the disease or condition. "Treating" does not necessarily require curative results. It is appreciated that, although not precluded, treating a disorder or condition also does not require that the disorder, condition, or symptoms associated therewith be completely eliminated. The term "treating" encompasses the concept of "managing" which refers to reducing the severity of a particular disease or disorder in a patient or delaying its recurrence, e.g., lengthening the period of remission in a patient who had suffered from the disease. "Treating" may refer to the application or administration or a composition to a subject after the onset, or suspected onset, of a disease or condition.

The term "treating" further encompasses the concept of "prevent," "preventing," and "prevention." The terms "prevent," "preventing," and "prevention," as used herein, refer to a decrease in the occurrence of pathology of a condition in a subject, who does not have, but is at risk of or susceptible to developing a disease or condition. The prevention may be complete, e.g., the total absence of pathology of a condition in a subject. The prevention may also be partial, such that the occurrence of pathology of a condition in a subject is less than that which would have occurred without the present disclosure.

By "treating or preventing a condition," for example, as compared with an equivalent untreated control, alleviating a symptom of a disorder may involve reduction or degree of prevention at least 3%, 5%, 10%, 20%, 40%, 50%, 60%, 80%, 90%, 95%, 98%, 99%, 99.5%, 99.9%, or 100% as measured by any standard technique. In some embodiments, alleviating a symptom of a disorder may involve reduction or degree of prevention by at least 2, 3, 4, 5, 10, 20, 25, 30, 40, 50, 60, 70, 80, 90, 100, 200, 300, 400, 500, 600, 700, 800, 900, 1000, 2000, 3000, 4000, 5000, 6000, 7000, 8000, 9000, or 10000 fold as compared with an equivalent untreated control.

As used therein, "delaying" the development of a disease means to defer, hinder, slow, retard, stabilize, and/or postpone progression of the disease. This delay can be of varying lengths of time, depending on the history of the disease and/or individuals being treated. A method that "delays" or alleviates the development of a disease, or delays the onset of the disease, is a method that reduces probability of developing one or more symptoms of the disease in a given time frame and/or reduces extent of the symptoms in a given time frame, when compared to not using the method. Such comparisons are typically based on clinical studies, using a number of subjects sufficient to give a statistically significant result.

"Development" or "progression" of a disease means initial manifestations and/or ensuing progression of the disease. Development of the disease can be detectable and assessed using standard clinical techniques as well known in the art. However, development also refers to progression that may be undetectable. For purpose of this disclosure, development or progression refers to the biological course of the symptoms. "Development" includes occurrence, recurrence, and onset.

As used herein "onset" or "occurrence" of a disease includes initial onset and/or recurrence.

"Administering" and its grammatical equivalents as used herein can refer to providing pharmaceutical compositions described herein to a subject or a patient. Conventional methods, known to those of ordinary skill in the art of medicine, can be used to administer the composition to the subject, depending upon the type of disease to be treated or the site of the disease. For example, the composition can be administered, e.g., orally, parenterally, by inhalation spray, topically, rectally, nasally, buccally, vaginally, via an implanted reservoir, or via infusion. One or more such routes can be employed.

The term "parenteral" as used herein includes subcutaneous, intracutaneous, intravenous, intramuscular, intraperitoneal, intradermal, intraarterial, intrasynovial, intrastemal, intrathecal, intravascular, intralesional, and intracranial injection or infusion techniques. In addition, it can be administered to the subject via injectable depot routes of administration such as using 1-, 3-, or 6-month depot injectable or biodegradable materials and methods.

By "co-administering" is meant administering one or more additional therapeutic regimens or agents or treatments and the composition of the disclosure sufficiently close in time to enhance the effect of one or more additional therapeutic agents, or vice versa. In this regard, the composition of the disclosure described herein can be administered simultaneously with one or more additional therapeutic regimens or agents or treatments, at a different time, or on an entirely different therapeutic schedule (e.g., the first treatment can be daily, while the additional treatment is weekly). For example, in embodiments, the secondary therapeutic regimens or agents or treatments are administered simultaneously, prior to, or subsequent to the composition of the disclosure.

The terms "pharmaceutical composition" and its grammatical equivalents as used herein can refer to a mixture or solution comprising a therapeutically effective amount of an active pharmaceutical ingredient together with one or more pharmaceutically acceptable excipients, carriers, and/or a therapeutic agent to be administered to a subject, e.g., a human in need thereof.

The term "pharmaceutically acceptable" and its grammatical equivalents as used herein can refer to an attribute of a material which is useful in preparing a pharmaceutical composition that is generally safe, non-toxic, and neither biologically nor otherwise undesirable and is acceptable for veterinary as well as human pharmaceutical use. "Pharmaceutically acceptable" can refer a material, such as a carrier or diluent, which does not abrogate the biological activity or properties of the compound, and is relatively nontoxic, i.e., the material may be administered to a subject without causing undesirable biological effects or interacting in a deleterious manner with any of the components of the pharmaceutical composition in which it is contained.

A "pharmaceutically acceptable excipient, carrier, or diluent" refers to an excipient, carrier, or diluent that can be administered to a subject, together with an agent, and which does not destroy the pharmacological activity thereof and is nontoxic when administered in doses sufficient to deliver a therapeutic amount of the agent.

A "pharmaceutically acceptable salt" may be an acid or base salt that is generally considered in the art to be suitable for use in contact with the tissues of human beings or animals without excessive toxicity, irritation, allergic response, or other problem or complication. Such salts include mineral and organic acid salts of basic residues such as amines, as well as alkali or organic salts of acidic residues such as carboxylic acids. Specific pharmaceutical salts include, but are not limited to, salts of acids such as hydrochloric, phosphoric, hydrobromic, malic, glycolic, fumaric, sulfuric, sulfamic, sulfanilic, formic, toluenesulfonic, methanesulfonic, benzene sulfonic, ethane disulfonic, 2-hydroxyethyl sulfonic, nitric, benzoic, 2-acetoxybenzoic, citric, tartaric, lactic, stearic, salicylic, glutamic, ascorbic, pamoic, succinic, fumaric, maleic, propionic, hydroxymaleic, hydroiodic, phenylacetic, alkanoic such as acetic, HOOC—$(CH_2)n$-COOH where n is 0-4, and the like.

Similarly, pharmaceutically acceptable cations include, but are not limited to sodium, potassium, calcium, aluminum, lithium and ammonium. Those of ordinary skill in the art will recognize from this disclosure and the knowledge in the art that further pharmaceutically acceptable salts include those listed by Remington's Pharmaceutical Sciences, 17th ed., Mack Publishing Company, Easton, PA, p. 1418 (1985). In general, a pharmaceutically acceptable acid or base salt can be synthesized from a parent compound that contains a basic or acidic moiety by any conventional chemical method. Briefly, such salts can be prepared by reacting the free acid or base forms of these compounds with a stoichiometric amount of the appropriate base or acid in an appropriate solvent.

The term "therapeutic agent" can refer to any agent that, when administered to a subject, has a therapeutic, diagnostic, and/or prophylactic effect and/or elicits a desired biological and/or pharmacological effect. Therapeutic agents can also be referred to as "actives" or "active agents." Such agents include, but are not limited to, cytotoxins, radioactive ions, chemotherapeutic agents, small molecule drugs, proteins, and nucleic acids.

"A therapeutically effective amount" as used herein refers to the amount of each composition of the present disclosure required to confer therapeutic effect on the subject, either alone or in combination with one or more other therapeutic agents. Hence, as used herein, the term "therapeutically effective amount" means an amount of an agent to be delivered (e.g., nucleic acid, composition, therapeutic agent, prophylactic agent, etc.) that is sufficient, when administered to a subject suffering from or susceptible to a disease, disorder, and/or condition, to treat, improve symptoms of, diagnose, prevent, and/or delay the onset of the disease, disorder, and/or condition. In terms of treatment, a "therapeutically effective amount" is an amount that is sufficient to palliate, ameliorate, stabilize, reverse or slow the progression of a disease or a condition, e.g., an atherosclerotic vascular disease, hypertriglyceridemia, or diabetes. A "therapeutically effective amount" varies, as recognized by those skilled in the art, depending on the particular condition being treated, the severity of the condition, the individual subject parameters including age, physical condition, size, gender and weight, the duration of the treatment, the nature of concurrent therapy (if any), the specific route of administration and like factors within the knowledge and expertise of the health practitioner. These factors are well known to those of ordinary skill in the art and can be addressed with no more than routine experimentation. It is generally preferred that a maximum dose of the individual components or combinations thereof be used, that is, the highest safe dose according to sound medical judgment. It will be understood by those of ordinary skill in the art, however, that a subject may insist upon a lower dose or tolerable dose for medical reasons, psychological reasons or for virtually any other reasons. Additionally, other medication the patient may be receiving will affect the determination of the therapeutically effective amount of the therapeutic agent to administer. Empirical considerations, such as the half-life, generally will contribute to the determination of the dosage. A "therapeutically effective amount" may be of any of the compositions of the disclosure used alone or in conjunction with one or more agents used to treat a condition. A therapeutically effective amount can be administered in one or more administrations.

An effective initial method to determine a "therapeutically effective amount" may be by carrying out cell culture assays (for example, using neuronal cells) or using animal models (for example, mice, rats, rabbits, dogs or pigs). A dose may be formulated in animal models to achieve a concentration range that includes the IC50 (i.e., the concentration of the composition which achieves a half-maximal inhibition of symptoms) as determined in cell culture. Such information can be used to more accurately determine useful doses in humans. In addition to determining the appropriate concentration range for an disclosure composition to be therapeutically effective, animal models may also yield other relevant information such as preferable routes of administration that will give maximum effectiveness. Adjusting the dose to achieve maximal efficacy in humans based on the methods described above and other methods is well within the capabilities of the ordinarily skilled artisan.

Ranges provided herein are understood to be shorthand for all of the values within the range. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50, as well as all intervening decimal values between the aforementioned integers such as, for example, 1.1, 1.2, 1.3, 1.4, 1.5, 1.6, 1.7, 1.8, and 1.9. With respect to sub-ranges, "nested sub-ranges" that extend from either end point of the range are specifically contemplated. For example, a nested sub-range of an exemplary range of 1 to 50 may comprise 1 to 10, 1 to 20, 1 to 30, and 1 to 40 in one direction, or 50 to 40, 50 to 30, 50 to 20, and 50 to 10 in the other direction.

The term "protospacer," or "target sequence" and their grammatical equivalents as used herein can refer to a DNA sequence of a target gene. In the native state, a protospacer is adjacent to a PAM (protospacer adjacent motif). The term "spacer" can be the RNA version of the protospacer that binds to the complementary strand of the protospacer. A spacer can be within a guide RNA (gRNA). The site of cleavage by an RNA-guided nuclease is within a protospacer sequence. Please see FIG. 1A for an illustration.

The term "base editing," "gene editing," or "gene modification" and its grammatical equivalents as used herein can refer to genetic engineering in which one or more nucleotides are inserted, replaced, or removed from a genome. Gene editing can be performed using a nuclease (e.g., a natural-existing nuclease or an artificially engineered nuclease). Gene modification can include introducing a double stranded break, a non-sense mutation, a frameshift mutation, a splice site alteration, or an inversion in a polynucleotide sequence, e.g., a target polynucleotide sequence.

The term "base editor (BE)" or "nucleobase editor (NBE)" as used herein can refer to an agent that binds a polynucleotide and has nucleobase modifying activity. In various embodiments, the base editor comprises a nucleobase modifying polypeptide (e.g., a deaminase) and a nucleic acid programmable nucleotide binding domain in conjunction with a guide polynucleotide (e.g., guide RNA), or nucleic acids encoding the programmable nucleotide binding domain and the deaminase. In various embodiments, the agent is a biomolecular complex comprising a protein domain having base editing activity, i.e., a domain capable of modifying a base (e.g., A, T, C, G, or U) within a nucleic acid molecule (e.g., DNA), or a nucleic acid encoding the same. In some embodiments, the polynucleotide programmable DNA binding domain is fused or linked to a deaminase domain, resulting in a base editor fusion protein. In some embodiments, the base editor comprises a nucleic acid encoding the base editor fusion protein, e.g., a mRNA encoding the base editor fusion protein. The base editor fusion protein may comprise one or more linkers, for example, peptide linkers. In one embodiment, the agent is a fusion protein comprising a domain having base editing activity. In another embodiment, the protein domain having base editing activity is linked to the guide RNA (e.g., via an RNA binding motif on the guide RNA and an RNA binding domain fused to the deaminase). In some embodiments, the domain having base editing activity is capable of deaminating a base within a nucleic acid molecule. In some embodiments, the base editor is capable of deaminating one or more bases within a DNA molecule. In some embodiments, the base editor is capable of deaminating an adenosine (A) within DNA. In some embodiments, the base editor is an adenosine base editor (ABE). In some embodiments, the base editor is capable of deaminating an cytosine (C) within DNA. In some embodiments, the base editor is a cytosine base editor (CBE).

The term "base editor system" refers to a system for editing a nucleobase of a target nucleotide sequence. In various embodiments, the base editor system comprises (1) a polynucleotide programmable nucleotide binding domain (e.g., Cas9); (2) a deaminase domain (e.g., an adenosine deaminase or a cytidine deaminase) for deaminating said nucleobase; and (3) one or more guide polynucleotide (e.g., guide RNA). In some embodiments, the base editor system comprises a base editor fusion protein comprising (1) and (2). In some embodiments, the polynucleotide programmable nucleotide binding domain is a polynucleotide programmable DNA binding domain. In some embodiments, the base editor is an adenine or adenosine base editor (ABE). In some embodiments, the base editor is a cytosine base editor (CBE).

Nucleobase Editor Systems

In some aspects, provided herein are base editor systems capable of nucleobase modifications. In some embodiments, the base editor system comprises (i) a guide polynucleotide or a nucleic acid encoding same, and (ii) a base editor fusion protein comprising a programmable DNA binding domain and a deaminase, or a nucleic acid encoding same. In some embodiments, the base editor system comprises a guide polynucleotide. In some embodiments, the base editor system comprises a nucleic acid encoding a guide polynucleotide. In some embodiments, the base editor system comprises a base editor fusion protein comprising a programmable DNA binding domain and a deaminase. In some embodiments, the base editor system comprises a nucleic acid encoding a base editor fusion protein comprising a programmable DNA binding domain and a deaminase.

In some embodiments, the guide polynucleotide directs the base editor system to effect a nucleobase alteration in a PCSK9 or ANGPTL3 gene in vivo when administered to a subject.

In some embodiments, the base alteration occurs in at least 35% of whole liver cells in the subject as measured by next generation sequencing or Sanger sequencing.

In some embodiments, the base alteration occurs in at least 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% of whole liver cells in the subject as measured by next generation sequencing or Sanger sequencing. In some embodiments, the base alteration occurs in at most 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% of whole liver cells in the subject as measured by next generation sequencing or Sanger sequencing. In some embodiments, the base alteration occurs in 1%-99.9%, 2%-99.9%, 3%-99.9%, 4%-99.9%, 5%-99.9%, 6%-99.9%, 7%-99.9%, 8%-99.9%, 9%-99.9%, 10%-99.9%, 15%-99.9%, 20%-99.9%, 25%-99.9%, 30%-99.9%, 35%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% of whole liver cells in the subject as measured by next generation sequencing or Sanger sequencing. In some embodiments, the base alteration occurs in 1%-990.5%, 1%-99%, 1%-98%, 1%-97%, 1%-96%, 1%-95%, 1%-90%, 1%-85%, 1%-80%, 1%-75%, 1%-70%, 1%-65%, 1%-60%, 1%-55%, 1%-50%, 1%-45%, 1%-40%, 1%-35%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% of whole liver cells in the subject as measured by next generation sequencing or Sanger sequencing. In some embodiments, the base alteration occurs in 1%-90%, 5%-85%, 10%-80%, 15%-75%, 20%-70%, 25%-65%, 30%-60%, 35%-55%, or 40%-50% of whole liver cells in the subject as measured by next generation sequencing or Sanger sequencing. In some embodiments, the base alteration occurs in 100% of whole liver cells in the subject as measured by next generation sequencing or Sanger sequencing.

In some embodiments, the base alteration occurs in hepatocytes in the subject. In some embodiments, the base alteration occurs in at least 30% of hepatocytes in the subject as measured by next generation sequencing or Sanger sequencing. In some embodiments, the base alteration occurs in hepatocytes in the subject. In some embodiments, the base alteration occurs in at least % of hepatocytes in the subject as measured by next generation sequencing or Sanger sequencing. In some embodiments, the base alteration occurs in at least 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% of hepatocytes in the subject as measured by next generation sequencing or Sanger sequencing. In some embodiments, the base alteration occurs in at most 1%, 2%, 3%, 4%, 5%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% of hepatocytes in the subject as measured by next generation sequencing or Sanger sequencing.

In some embodiments, the base alteration occurs in 1%-99.9%, 2%-99.9%, 3%-99.9%, 4%-99.9%, 5%-99.9%, 6%-99.9%, 7%-99.9%, 8%-99.9%, 9%-99.9%, 100%-99.9%, 15%-99.9%, 20%-99.9%, 25%-99.9%, 30%-99.9%, 35%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% of hepatocytes in the subject as measured by next generation sequencing or Sanger sequencing. In some embodiments, the base alteration occurs in 1%-99.5%, 1%-99%, 1%-98%, 1%-97%, 1%-96%, 1%-95%, 1%-90%, 1%-85%, 1%-80%, 1%-75%, 1%-70%, 1%-65%, 1%-60%, 1%-55%, 1%-50%, 1%-45%, 1%-40%, 1%-35%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% hepatocytes in the subject as measured by next generation sequencing or Sanger sequencing. In some embodiments, the base alteration occurs in 1%-90%, 5%-85%, 10%-80%, 15%-75%, 20%-70%, 25%-65%, 30%-60%, 35%-55%, or 40%-50% of hepatocytes in the subject as measured by next generation sequencing or Sanger sequencing.

In some embodiments, the base alteration occurs in 100% of hepatocytes in the subject as measured by next generation sequencing or Sanger sequencing.

In some embodiments, the base alteration occurred in whole liver cells in the subject is measured by next generation sequencing. In some embodiments, the base alteration occurred in whole liver cells in the subject is measured by Sanger sequencing. In some embodiments, the base alteration occurred in hepatocytes in the subject is measured by next generation sequencing. In some embodiments, the base alteration occurred in hepatocytes in the subject is measured by Sanger sequencing.

In some embodiments, the nucleobase alteration results in a reduction of at least 35% in blood PCSK9 protein level in the subject as compared to prior to the administration as measured by ELISA, Western blots, or LC-MS/MS. In some embodiments, the nucleobase alteration results in a reduction of at least 35% in blood ANGPTL3 protein level in the subject as compared to prior to the administration as measured by ELISA, Western blots, or LC-MS/MS In some embodiments, the nucleobase alteration results in a reduction of at least 30%, 35%, 40%, 45%, 50%, 55%, 60%, 65%, 70%, 75%, 80%, 85%, 90%, 95%, 97%, 98%, or 99% in blood PCSK9 protein level in the subject as compared to prior to the administration as measured by ELISA, Western blots, or LC-MS/MS. In some embodiments, the nucleobase alteration results in a reduction of at least 1%, 2%, 3%, 4%, 5%, 6%, 7%, 8%, 9%, 10%, 15%, 20%, 25%, 30%, 31%, 32%, 33%, 34%, 35%, 36%, 37%, 38%, 39%, 40%, 45%, 50%, 55%, 60%, 65%, 70%, 71%, 72%, 73%, 74%, 75%, 76%, 77%, 78%, 79%, 80%, 85%, 90%, 95%, 97%, 98%, 90%, 95%, 97%, 98%, 99%, 99.3%, 99.5%, 99.7%, 99.8%, or 99.9% in blood PCSK9 protein level in the subject as compared to prior to the administration as measured by ELISA, Western blots, or LC-MS/MS. In some embodiments, the nucleobase alteration results in a reduction of at most 1%, 2%, 3%, 4%, 5%, 6%, 7%, 8%, 9%, 10%, 15%, 20%, 25%, 30%, 31%, 32%, 33%, 34%, 35%, 36%, 37%, 38%, 39%, 40%, 45%, 50%, 55%, 60%, 65%, 70%, 71%, 72%, 73%, 74%, 75%, 76%, 77%, 78%, 79%, 80%, 85%, 90%, 95%, 97%, 98%, 90%, 95%, 97%, 98%, 99%, 99.3%, 99.5%, 99.7%, 99.8%, or 99.9% in blood PCSK9 protein level in the subject as compared to prior to the administration as measured by ELISA, Western blots, or LC-MS/MS. In some embodiments, the nucleobase alteration results in a reduction of 1%-99.9%, 2%-99.9%, 3%-99.9%, 4%-99.9%, 5%-99.9%, 6%-99.9%, 7%-99.9%, 8%-99.9%, 9%-99.9%, 100%-99.9%, 15%-99.9%, 20%-99.9%, 25%-99.9%, 30%-99.9%, 31%-99.9%, 32%-99.9%, 33%-99.9%, 34%-99.9%, 35%-99.9%, 36%-99.9%, 37%-99.9%, 38%-99.9%, 39%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% in blood PCSK9 protein level in the subject as compared to prior to the administration as measured by ELISA, Western blots, or LC-MS/MS. In some embodiments, the nucleobase alteration results in a reduction of 1%-990.5%, 1%-99%, 1%-98%, 1%-97%, 1%-96%, 1%-95%, 1%-90%, 1%-85%, 1%-80%, 1%-79%, 1%-78%, 1%-77%, 1%-76%, 1%-75%, 1%-74%, 1%-73%, 1%-72%, 1%-71%, 1%-70%, 1%-65%, 1%-60%, 1%-55%, 1%-50%, 1%-45%, 1%-40%, 1%-39%, 1%-38%, 1%-37%, 1%-36%, 1%-35%, 1%-34%, 1%-33%, 1%-32%, 1%-31%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% in blood PCSK9 protein level in the subject as compared to prior to the administration as measured by ELISA, Western blots, or LC-MS/MS. In some embodiments, the nucleobase alteration results in a reduction of 1%-99.9%, 5%-99.5%, 10%-99%, 15%-97%, 20%-95%, 25%-90%, 30%-85%, 31%-80%, 32%-79%, 33%-78%, 34%-77%, 35%-76%, 36%-76%, 37%-75%, 38%-74%, 39%-73%, 40%-72%, 45%-71%, 50%-70%, or 55%-65% in blood PCSK9 protein level in the subject as compared to prior to the administration as measured by ELISA, Western blots, or LC-MS/MS. In some embodiments, the nucleobase alteration results in a reduction of 100% in blood PCSK9 protein level in the subject as compared to prior to the administration as measured by ELISA, Western blots, or LC-MS/MS.

In some embodiments, the nucleobase alteration results in at least 1%, 2%, 3%, 4%, 5%, 6%, 7%, 8%, 9%, 10%, 11%, 12%, 13%, 14%, 1%, 200%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, 1000% less blood PCSK9 protein level in the subject as compared to prior to the administration as measured by ELISA, Western blots, or LC-MS/MS. In some embodiments, the nucleobase alteration results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less blood PCSK9 protein level in the subject as compared to prior to the administration as measured by ELISA, Western blots, or LC-MS/MS.

In some embodiments, the reduction of blood PCSK9 protein level or the blood PCSK9 protein level in the subject as compared to prior to the administration is measured by ELISA (enzyme-linked immunosorbent assay). In some embodiments, the reduction of blood PCSK9 protein level or the blood PCSK9 protein level in the subject as compared to prior to the administration is measured by Western blot analysis. In some embodiments, the reduction of blood PCSK9 protein level or the blood PCSK9 protein level in the subject as compared to prior to the administration is measured by LC-MS/MS (liquid chromatography-tandem mass spectrometry).

In some embodiments, the nucleobase alteration results in a reduction of at least 30%, 35%, 40%, 45%, 50%, 55%, 60%, 65%, 70%, 75%, 80%, 85%, 90%, 95%, 97%, 98%, or 99% in blood ANGPTL3 protein level in the subject as compared to prior to the administration as measured by ELISA, Western blots, or LC-MS/MS. In some embodiments, the nucleobase alteration results in a reduction of at least 1%, 2%, 3%, 4%, 5%, 6%, 7%, 8%, 9%, 10%, 15%, 20%, 25%, 30%, 31%, 32%, 33%, 34%, 35%, 36%, 37%, 38%, 39%, 40%, 45%, 50%, 55%, 60%, 65%, 70%, 71%, 72%, 73%, 74%, 75%, 76%, 77%, 78%, 79%, 80%, 85%, 90%, 95%, 97%, 98%, 90%, 95%, 97%, 98%, 99%, 99.3%, 99.5%, 99.7%, 99.8%, or 99.9% in blood ANGPTL3 protein level in the subject as compared to prior to the administration as measured by ELISA, Western blots, or LC-MS/MS. In some embodiments, the nucleobase alteration results in a reduction of at most 1%, 2%, 3%, 4%, 5%, 6%, 7%, 8%, 9%, 10%, 15%, 20%, 25%, 30%, 31%, 32%, 33%, 34%, 35%, 36%, 37%, 38%, 39%, 40%, 45%, 50%, 55%, 60%, 65%, 70%, 71%, 72%, 73%, 74%, 75%, 76%, 77%, 78%, 79%, 80%, 85%, 90%, 95%, 97%, 98%, 90%, 95%, 97%, 98%, 99%, 99.3%, 99.5%, 99.7%, 99.8%, or 99.9% in blood ANGPTL3 protein level in the subject as compared to prior to the administration as measured by ELISA, Western blots, or LC-MS/MS. In some embodiments, the nucleobase alteration results in a reduction of 1%-99.9%, 2%-99.9%, 3%-99.9%, 4%-99.9%, 5%-99.9%, 6%-99.9%, 7%-99.9%, 8%-99.9%, 9%-99.9%, 100%-99.9%, 15%-99.9%, 20%-99.9%, 25%-99.9%, 30%-99.9%, 31%-99.9%, 32%-99.9%, 33%-99.9%, 34%-99.9%, 35%-99.9%, 36%-99.9%, 37%-99.9%, 38%-99.9%, 39%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% in blood ANGPTL3 protein level in the subject as compared to prior to the administration as measured by ELISA, Western blots, or LC-MS/MS. In some embodiments, the nucleobase alteration results in a reduction of 1%-99.5%, 1%-99%, 1%-98%, 1%-97%, 1%-96%, 1%-95%, 1%-90%, 1%-85%, 1%-80%, 1%-79%, 1%-78%, 1%-77%, 1%-76%, 1%-75%, 1%-74%, 1%-73%, 1%-72%, 1%-7%, 1%-70%, 1%-65%, 1%-60%, 1%-55%, 1%-50%, 1%-45%, 1%-40%, 1%-39%, 1%-38%, 1%-37%, 1%-36%, 1%-35%, 1%-34%, 1%-33%, 1%-32%, 1%-3%, 1%0-30%, 1%-25%, 1%-20%, 1%-15%, 1%-10%, 1%-9%, 1%-8%, 1%-7%, 1%-6%, 1%-5%, 1%-4%, 1%-3%, or 1%-2% in blood ANGPTL3 protein level in the subject as compared to prior to the administration as measured by ELISA, Western blots, or LC-MS/MS. In some embodiments, the nucleobase alteration results in a reduction of 1%-99.9%, 5%-99.5%, 10%-99%, 15%-97%, 20%-95%, 25%-90%, 30%-85%, 31%-80%, 32%-79%, 33%-78%, 34%-77%, 35%-76%, 36%-76%, 37%-75%, 38%-74%, 39%-73%, 40%-72%, 45%-71%, 50%-70%, or 55%-65% in blood ANGPTL3 protein level in the subject as compared to prior to the administration as measured by ELISA, Western blots, or LC-MS/MS. In some embodiments, the nucleobase alteration results in a reduction of 100% in blood ANGPTL3 protein level in the subject as compared to prior to the administration as measured by ELISA, Western blots, or LC-MS/MS.

In some embodiments, the nucleobase alteration results in at least 1%, 2%, 3%, 4%, 5%, 6%, 7%, 8%, 9%, 10, 1%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, 1000% less blood ANGPTL3 protein level in the subject as compared to prior to the administration as measured by ELISA, Western blots, or LC-MS/MS. In some embodiments, the nucleobase alteration results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less blood ANGPTL3 protein level in the subject as compared to prior to the administration as measured by ELISA, Western blots, or LC-MS/MS.

In some embodiments, the reduction of blood ANGPTL3 protein level or the blood ANGPTL3 protein level in the subject as compared to prior to the administration is measured by ELISA (enzyme-linked immunosorbent assay). In some embodiments, the reduction of blood ANGPTL3 protein level or the blood ANGPTL3 protein level in the subject as compared to prior to the administration is measured by Western blot analysis. In some embodiments, the reduction of blood ANGPTL3 protein level or the blood ANGPTL3 protein level in the subject as compared to prior to the administration is measured by LC-MS/MS (liquid chromatography-tandem mass spectrometry).

In some embodiments, the nucleobase alteration results in a reduction of at least 35% in blood or low-density lipoprotein cholesterol (LDL-C) levels in the subject as compared to prior to the administration. In some embodiments, the nucleobase alteration results in a reduction of at least 35%, 40%, 45%, 46%, 47%, 48%, 49%, 50%, 51%, 52%, 53%, 54%, 55%, 56%, 57%, 58%, 59%, 60%, 61%, 62%, 63%, 64%, 65%, 70%, 75%, 80%, 85%, 90%, 95%, 97%, 98%, or 99% in blood low-density lipoprotein cholesterol (LDL-C) level in the subject as compared to prior to the administration. In some embodiments, the nucleobase alteration results in a reduction of at least 1%, 2%, 3%, 4%, 5%, 6%, 7%, 8%, 9%, 10%, 15%, 20%, 25%, 30%, 35%, 40%, 45%, 46%, 47%, 48%, 49%, 50%, 51%, 52%, 53%, 54%, 55%, 56%, 57%, 58%, 59%, 60%, 61%, 62%, 63%, 64%, 65%, 70%, 75%, 80%, 85%, 90%, 95%, 97%, 98%, 99%, 99.3%, 99.5%, 99.7%, 99.8%, or 99.9% in blood low-density lipoprotein cholesterol (LDL-C) level in the subject as compared to prior to the administration. In some embodiments, the nucleobase alteration results in a reduction of at most 1%, 2%, 3%, 4%, 5%, 6%, 7%, 8%, 9%, 10%, 15%, 210, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% in blood low-density lipoprotein cholesterol (LDL-C) level in the subject as compared to prior to the administration. In some embodiments, the nucleobase alteration results in a reduction of 1%-99.9%, 2%-99.9%, 3%-99.9%, 4%-99.9%, 5%-99.9%, 6%-99.9%, 7%-99.9%, 8%-99.9%, 9%-99.9%, 100%-99.9%, 15%-99.9%, 20%-99.9%, 25%-99.9%, 30%-99.9%, 35%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% in blood low-density lipoprotein cholesterol (LDL-C) level in the subject as compared to prior to the administration. In some embodiments, the nucleobase alteration results in a reduction of 1%-99.5%, 1%-99%, 1%-98%, 1%-97%, 1%-96%, 1%-95%, 1%-90%, 1%-85%, 1%-80%, 1%-75%, 1%-70%, 1%-65%, 1%-60%, 1%-55%, 1%-50%, 1%-45%, 1%-40%, 1%-35%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% in blood low-density lipoprotein cholesterol (LDL-C) level in the subject as compared to prior to the administration. In some embodiments, the nucleobase alteration results in a reduction of 1%-99.9%, 5%-99.5%, 10%-99%, 15%-97%, 20%-95%, 25%-90%, 30%-85%, 35%-80%, 40%-75%, 45%-70%, 50%-65%, or 55%-60% in blood low-density lipoprotein cholesterol (LDL-C) level in the subject as compared to prior to the administration. In some embodiments, the nucleobase alteration results in a reduction of 100% in blood low-density lipoprotein cholesterol (LDL-C) level in the subject as compared to prior to the administration. In some embodiments, the nucleobase alteration results in at least 1%, 2%, 3%, 4%, 5%, 6%, 7%, 8%, 9% 10%, 110, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, 1000% less blood low-density lipoprotein cholesterol (LDL-C) level in the subject as compared to prior to the administration. In some embodiments, the nucleobase alteration results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less blood low-density lipoprotein (LDL-C) level in the subject as compared to prior to the administration.

In some embodiments, the nucleobase alteration results in a reduction of at least 35% in blood triglyceride levels in the subject as compared to prior to the administration. In some embodiments, the nucleobase alteration results in a reduction of at least 30%, 35%, 40%, 45%, 46%, 47%, 48%, 49%, 50%, 51%, 52%, 53%, 54%, 55%, 56%, 57%, 58%, 59%, 60%, 61%, 62%, 63%, 64%, 65%, 70%, 75%, 80%, 85%, 90%, 95%, 97%, 98%, or 99% in blood triglyceride level in the subject as compared to prior to the administration. In some embodiments, the nucleobase alteration results in a reduction of at least 1%, 2%, 3%, 4%, 5%, 6%7, 7%, 8%, 9%, 10%, 15%, 20%, 25%, 30%, 35%, 420%, 45%, 46%, 47%, 48%, 49%, 50%, 51%, 52%, 53%, 54%, 55%, 56%, 57%, 58%, 59%, 60%, 61%, 62%, 63%, 64%, 65%, 70%, 75%, 80%, 85%, 90%, 95%, 97%, 98%, 99%, 99.3%, 99.5%, 99.7%, 99.8%, or 99.9% in blood triglyceride level in the subject as compared to prior to the administration. In some embodiments, the nucleobase alteration results in a reduction of at most 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% in blood triglyceride level in the subject as compared to prior to the administration. In some embodiments, the nucleobase alteration results in a reduction of 1%-99.9%, 2%-99.9%, 3%-99.9%, 4%-99.9%, 5%-99.9%, 6%-99.9%, 7%-99.9%, 8%-99.9%, 9%-99.9%, 10%-99.9%, 15%-99.9%, 20%-99.9%, 25%-99.9%, 30%-99.9%, 35%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% in blood triglyceride level in the subject as compared to prior to the administration. In some embodiments, the nucleobase alteration results in a reduction of 1%-99.5%, 1%-99%, 1%-98%, 1%-97%, 1%-96%, 1%-95%, 1%-90%, 1%-85%, 1%-80%, 1%-75%, 1%-70%, 1%-65%, 1%-60%, 1%-55%, 1%-50%, 1%-45%, 1%-40%, 1%-35%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% in blood triglyceride level in the subject as compared to prior to the administration. In some embodiments, the nucleobase alteration results in a reduction of 1%-99.9%, 5%-99.5%, 10%-99%, 15%-97%, 20%-95%, 25%-90%, 30%-85%, 35%-80%, 40%-75%, 45%-70%, 50%-65%, or 55%-60% in blood triglyceride level in the subject as compared to prior to the administration. In some embodiments, the nucleobase alteration results in a reduction of 100% in blood triglyceride level in the subject as compared to prior to the administration. In some embodiments, the nucleobase alteration results in at least 1%, 2%, 3%, 4%, 5%, 6%, 7%, 8%, 9%, 1%, 11%, $1^2$%, 3%, 14%, %15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, 1000% less blood triglyceride level in the subject as compared to prior to the administration. In some embodiments, the nucleobase alteration results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less blood triglyceride level in the subject as compared to prior to the administration.

In some embodiments, the blood triglyceride level or the reduction of blood triglyceride level in the subject as compared to prior to the administration is measured by any standard technique. In some embodiments, the blood low-density lipoprotein cholesterol (LDL-C) level or the reduction of blood low-density lipoprotein cholesterol (LDL-C) level in the subject as compared to prior to the administration is measured by any standard technique. For example, a clinical analyzer instrument may be used to measure a 'lipid panel' in serum samples which entails the direct measurement of cholesterol (total C), triglycerides (TG) and high-density lipoprotein cholesterol (HDL-C) enzymatically. Reagent kits specific for each analyte contain buffers, calibrators, blanks and controls. As used in the present disclosure, cholesterol, triglycerides and HDL-C may be quantified using absorbance measurements of specific enzymatic reaction products. LDL-C may be determined indirectly. In some instances, most of circulating cholesterol can be found in three major lipoprotein fractions: very low-density lipoproteins (VLDL), LDL and HDL. In some embodiments, total circulating cholesterol may be estimated with the formula [Total C]=[VLDL-C]+[LDL-C]+[HDL-C]. Thus the LDL-C can be calculated from measured values of total cholesterol, triglycerides and HDL-C according to the relationship: [LDL-C]=[total C]− [HDL-C]-[TG]/5, where [TG]/5 is an estimate of VLDL-cholesterol. A reagent kit specific for triglycerides containing buffers, calibrators, blanks and controls may be used. As used herein, serum samples from the study may be analyzed and triglycerides may be measured using a series of coupled enzymatic reactions. In some embodiments, $H_2O_2$ may be used to quantify the analyte as the end product of the last one and its absorbance at 500 nm, and the color intensity is proportional to triglyceride concentrations.

In some embodiments, the guide polynucleotide is a guide RNA, wherein the guide RNA comprises a spacer sequence that binds to the complementary strand of a protospacer sequence of the PCSK9 gene with 0, 1, or 2 mismatches. In some embodiments, the guide RNA comprises a spacer sequence that binds to the complementary strand of a protospacer sequence of the PCSK9 gene with no mismatches. In some embodiments, the guide RNA comprises a spacer sequence that binds to the complementary strand of a protospacer sequence of the PCSK9 gene with 1 mismatch. In some embodiments, the guide RNA comprises a spacer sequence that binds to the complementary strand of a protospacer sequence of the PCSK9 gene with 2 mismatches. In some embodiments, the guide RNA comprises a spacer sequence that binds to the complementary strand of a protospacer sequence of the PCSK9 gene with 3 mismatches. In some embodiments, the guide RNA comprises a spacer sequence that binds to the complementary strand of a protospacer sequence of the PCSK9 gene with 4 mismatches. In some embodiments, the guide RNA comprises a spacer sequence that binds to the complementary strand of a protospacer sequence of the PCSK9 gene with 5 mismatches.

In some embodiments, the guide polynucleotide is a guide RNA, wherein the guide RNA comprises a spacer sequence that binds to the complementary strand of a protospacer sequence of the ANGPTL3 gene with 0, 1, or 2 mismatches. In some embodiments, the guide RNA comprises a spacer sequence that binds to the complementary strand of a protospacer sequence of the ANGPTL3 gene with no mismatches. In some embodiments, the guide RNA comprises a spacer sequence that binds to the complementary strand of a protospacer sequence of the ANGPTL3 gene with 1 mismatch. In some embodiments, the guide RNA comprises a spacer sequence that binds to the complementary strand of a protospacer sequence of the ANGPTL3 gene with 2 mismatches. In some embodiments, the guide RNA comprises a spacer sequence that binds to the complementary strand of a protospacer sequence of the ANGPTL3 gene with 3 mismatches. In some embodiments, the guide RNA comprises a spacer sequence that binds to the complementary strand of a protospacer sequence of the ANGPTL3 gene with 4 mismatches. In some embodiments, the guide RNA comprises a spacer sequence that binds to the complementary strand of a protospacer sequence of the ANGPTL3 gene with 5 mismatches.

In some embodiments, the nucleobase alteration is outside of the protospacer sequence in less than 1% of whole liver cells in the subject as measured by net nucleobase editing. In some embodiments, the nucleobase alteration is outside of the protospacer sequence in less than 1% of hepatocytes in the subject as measured by net nucleobase editing.

In some embodiments, the nucleobase alteration is only within the protospacer sequence as measured by net nucleobase editing.

In some embodiments, the nucleobase alteration is outside of the protospacer sequence in less than 0.01%. 0.02%, 0.03% 0.04%, 0.05%, 0.06%, 0.07%, 0.08%, 0.09%, 0.1%, 0.2%, 0.3%, 0.4%, 0.5%, 0.6%, 0.7%, 0.8%, 0.9%0, 1.0%, 2.0%, 3.0% 4.0%, 5.0%, 6.0%, 7.0%, 8.0%, 9.0%1, 10%, 15%, 20%, 25%, 30%, 35%, 40%, 45%, 50%, 55%, 60%, 65%, 70%, 65%, 80%, 85%, 90% of whole liver cells in the subject as measured by net nucleobase editing. In some embodiments, the nucleobase alteration is outside of the protospacer sequence in less than 0.01%. 0.02%, 0.03% 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1.0%, 2.0%, 3.0% 4.0%, 5.0%, 6.0%, 7.0%, 8.0%, 9.0%0, 10%, 15%, 20%, 25%, 30%, 35%, 40%, 45%, 50%, 55%, 60%, 65%, 70%, 65%, 80%, 85%, 90% of hepatocytes in the subject as measured by net nucleobase editing. In some embodiments, the nucleobase alteration is outside of the protospacer sequence in less than 0.01%. 0.02%, 0.03% 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1.0%, 2.0%, 3.0% 4.0%, 5.0%, 6.0%, 7.0%, 8.0%, 9.0%0, 10%, 15%, 20%, 25%, 30%, 35%, 40%, 45%, 50%, 55%, 60%, 65%, 70%, 65%, 80%, 85%, 90% of cells in the subject as measured by net nucleobase editing.

In some embodiments, the deaminase is an adenine deaminase. In some embodiments, the nucleobase alteration is a A·T to G·C alteration. In some embodiments, the deaminase is an adenine deaminase and the nucleobase alteration is a A·T to G·C alteration. In some embodiments, the programmable DNA binding domain comprises a nuclease inactive Cas9 or a Cas9 nickase. In some embodiments, the programmable DNA binding domain comprises a Cas9.

In some embodiments, the nucleobase alteration is at a splice site of the PCSK9 gene. In some embodiments, the nucleobase alteration is at a splice donor site of the PCSK9 gene. In some embodiments, the splice donor site is at 5' end of PCSK9 intron 1 as referenced in SEQ ID NO: 5. In some embodiments, the nucleobase alteration is at a splice acceptor site of the PCSK9 gene. In some embodiments, the nucleobase alteration results in a frame shift, a premature stop codon, or insertion or deletion in a transcript encoded by the PCSK9 gene. In some embodiments, the nucleobase alteration results in an aberrant transcript encoded by the PCSK9 gene. In some embodiments, the guide polynucleotide is a guide RNA. In some embodiments, the guide RNA is chemically modified. In some embodiments, the guide RNA comprises a tracrRNA sequence. In some embodiments, the guide RNA comprises a chemical modification as set forth in Table 1 or Table 24.

In some embodiments, the nucleobase alteration is at a splice site of the ANGPTL3 gene. In some embodiments, the nucleobase alteration is at a splice donor site of the ANGPTL3 gene. In some embodiments, the splice donor site is at 5' end of ANGPTL3 intron 6 as referenced in SEQ ID NO: 7. In some embodiments, the nucleobase alteration is at a splice acceptor site of the ANGPTL3 gene. In some embodiments, the nucleobase alteration results in a frame shift, a premature stop codon, a insertion or deletion in a transcript encoded by the ANGPTL3 gene. In some embodiments, the nucleobase alteration results in an aberrant transcript encoded by the ANGPTL3 gene. In some embodiments, the guide polynucleotide is a guide RNA. In some embodiments, the guide RNA is chemically modified. In some embodiments, the guide RNA comprises a tracrRNA sequence. In some embodiments, the guide RNA comprises a chemical modification as set forth in Table 1 or Table 24.

In some embodiments, the guide RNA comprises a guide RNA sequence set forth in Table 1 or Table 24. In some embodiments, the guide RNA comprises the sequence (SEQ ID NO: 9)
5'-5'-cscscsGCACCUUGGCGCAGCGGgUUUUAGagcuaGaaauagca
aGUUaAaAuAaggCUaGUCcG UUAucAAcuuGaaaaaguGgcaccgAgU
Cggugcusususu-3', (SEQ ID NO: 9)
5'-cscscsGCACCUUGGCGCAGCGGgUUUUAGagcuagaaauagcaaGU
UaAaAuAaggcuaGUccGU UAucAAcuugaaaaagugGcaccgagucgg
ugcusususu-3', (SEQ ID NO: 9)
5'-cscscsGCACCUUGGCGCAGCGGgUUUUAGagcuaGaaauagcaaGU
UaAaAuAaggcuaGUccGUUAucAAcuuGaaaaagugGcaccgagucggu
gcusususu-3' (GA346), (SEQ ID NO: 10)
5'-cscscsGCACCUUGGCGCAGCGGgUUUUAGagcuagaaauagcaaGU
UaAaAuAaggcuaGUccGUUAacAAcuugaaaaagugGcaccgagucggu
gcusususu-3' (GA374), (SEQ ID NO: 11)
5'-cscscsGCACCUUGGCGCAGCGGgUUUUAGagcuagaaauagcaaGU
UaAaAuAaggcuaGUccGUUAucAAcuugaaaaagugGcaccgagucggu
gcusususuuuu-3' (GA385), (SEQ ID NO: 11)
5'-cscscsGCACCUUGGCGCAGCGGgUUUUAGagcuagaaauagcaaGU
UaAaAuAaggcuaGUccGUUAucAAcuugaaaaagugGcaccgagucggu
gcusususuuUu-3' (GA386)

or (SEQ ID NO: 12)
5'-cscscsGCACCUUGGCGCAGCGgUUUUAGagcuaGaaauagcaaGUU
aAaAuAaggcuaGUccGUUAucAAcuuGaaaaagugGcaccgagucggug
cuusususuuuu-3' (GA387).

In some embodiments, the protospacer sequence comprises a protospacer sequence set forth in Table 1 or Table 24. In some embodiments, the protospacer comprises the sequence (SEQ ID NO: 13)
5'-CCCGCACCTTGGCGCAGCGG-3', (SEQ ID NO: 14)
AAGATACCTGAATAACTCTC-3', -continued and (SEQ ID NO: 15)
5'-AAGATACCTGAATAACCCTC-3'.

In some embodiments, the base editor fusion protein comprises the sequence of SEQ ID NO: 3. In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the amino acid sequence set forth in SEQ ID NO: 3 or to any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to the amino acid sequence set forth in SEQ ID NO: 3 or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NO: 3 or any of the adenosine deaminases provided herein.

In some embodiments, the nucleic acid encoding the base editor fusion protein is a mRNA. The mRNA may comprise modifications, for example, modifications at 3' or 5' end of the mRNA. In some embodiments, the mRNA comprises a cap analog.

In some embodiments, the mRNA comprises at least 1, 2, or 3 nucleotides at the 5' end that comprises 2'-hydroxyl group, 2'-O-methyl group, or additional 2' chemical modification or a combination thereof. In some embodiments, the mRNA comprises at least 1, 2, or 3 nucleotides at the 5' end that comprises 2'-hydroxyl group, 2'-O-methyl group, or additional 2' chemical modification or a combination thereof. In some embodiments, the mRNA comprises at least 1 nucleotide at the 5' end that comprises 2'-hydroxyl group, 2'-O-methyl group, or additional 2' chemical modification or a combination thereof. In some embodiments, the mRNA comprises at least 2 nucleotides at the 5' end that comprises 2'-hydroxyl group, 2'-O-methyl group, or additional 2' chemical modification or a combination thereof. In some embodiments, the mRNA comprises at least 3 nucleotides at the 5' end that comprises 2'-hydroxyl group, 2'-O-methyl group, or additional 2' chemical modification or a combination thereof. In some embodiments, the mRNA comprises at least 4 nucleotides at the 5' end that comprises 2'-hydroxyl group, 2'-O-methyl group, or additional 2' chemical modification or a combination thereof. In some embodiments, the mRNA comprises at least 5 nucleotides at the 5' end that comprises 2'-hydroxyl group, 2'-O-methyl group, or additional 2' chemical modification or a combination thereof. In some embodiments, the mRNA comprises at least 6 nucleotides at the 5' end that comprises 2'-hydroxyl group, 2'-O-methyl group, or additional 2' chemical modification or a combination thereof. In some embodiments, the mRNA comprises at least 7 nucleotides at the 5' end that comprises 2'-hydroxyl group, 2'-O-methyl group, or additional 2' chemical modification or a combination thereof. In some embodiments, the mRNA comprises at least 8 nucleotides at the 5' end that comprises 2'-hydroxyl group, 2'-O-methyl group, or additional 2' chemical modification or a combination thereof. In some embodiments, the mRNA comprises at least 9 nucleotides at the 5' end that comprises 2'-hydroxyl group, 2'-O-methyl group, or additional 2' chemical modification or a combination thereof. In some embodiments, the mRNA comprises at least 10 nucleotides at the 5' end that comprises 2'-hydroxyl group, 2'-O-methyl group, or additional 2' chemical modification or a combination thereof.

In some embodiments, the mRNA comprises a poly A tail. The poly A tail may be at the 3' end of the mRNA.

In some embodiments, the GC % content of the mRNA sequence is greater than or equal to 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89% or 90%. In some embodiments, the GC % content of the mRNA sequence is greater than or equal to 40%, 45%, 50%, 55%, 60%, 65%, 70%, 75% or 80%.

In some embodiments, the mRNA sequence comprises an adenine tTNA deaminase (TadA) region. In some embodiments, the GC % of the TadA region is greater than or equal to 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89% or 90%. In some embodiments, the GC % content of the TadA region is greater than or equal to 40%, 45%, 50%, 55%, 60%, 65%, 70%, 75% or 80%.

In some embodiments, the mRNA sequence comprises a Cas9 region. In some embodiments, the GC % of the Cas9 region is greater than or equal to 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89% or 90%. In some embodiments, the GC % content of the Cas9 region is greater than or equal to 40%, 45%, 50%, 55%, 60%, 65%, 70%, 75% or 80%.

In some embodiments, the mRNA sequence comprises a NLS region. In some embodiments, the GC % of the NLS region is greater than or equal to 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89% or 90%. In some embodiments, the GC % content of the NLS region is greater than or equal to 40%, 45%, 50%, 55%, 60%, 65%, 70%, 75% or 80%.

In some embodiments, the mRNA sequence comprises a first linker region that connects the TadA region and the Cas9 region. In some embodiments, the GC % of the first linker region is greater than or equal to 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89% or 90%. In some embodiments, the GC % content of the first linker region is greater than or equal to 40%, 45%, 50%, 55%, 60%, 65%, 70%, 75% or 80%.

In some embodiments, the mRNA sequence comprises a second linker region that connects the Cas9 region and the NLS region. In some embodiments, the GC % of the second linker region is greater than or equal to 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89% or 90%. In some embodiments, the GC % content of the second linker region is greater than or equal to 40%, 45%, 50%, 55%, 60%, 65%, 70%, 75% or 80%.

In some embodiments, the base editor system as provided herein further comprises a lipid nanoparticle (LNP) enclosing a guide polynucleotide or a nucleic acid encoding the guide polynucleotide (i). In some embodiments, the LNP further encloses a base editor fusion protein comprising a programmable DNA binding domain and a deaminase, or a nucleic acid encoding same (ii). In some embodiments, the base editor system further comprises a second LNP enclosing a base editor fusion protein comprising a programmable DNA binding domain and a deaminase, or a nucleic acid encoding same (ii).

A base editor system as provided herein can include one or more LNPs. For example, a base editor system may comprise a LNP enclosing both a guide polynucleotide and a nucleic acid encoding the base editor fusion protein, e.g. an mRNA encoding the base editor fusion protein. In another example, a base editor system may comprise a LNP enclosing a guide polynucleotide, e.g. a guide RNA, and a LNP enclosing a nucleic acid, e.g. an mRNA, encoding the base editor fusion protein. LNPs separately enclosing the guide polynucleotide and the base editor fusion protein or mRNA encoding the base editor fusion protein may allow for flexible dosing and administration of the base editor system. For example, a LNP enclosing a guide RNA can be administered first, followed by administration of a LNP enclosing a mRNA encoding the base editor fusion protein. In some embodiments, a LNP enclosing a guide RNA and a second LNP enclosing a mRNA encoding the base editor fusion protein are administered to a subject at the same time. In some embodiments, a LNP enclosing a guide RNA and a LNP enclosing a mRNA encoding the base editor protein are administered to a subject sequentially. In some embodiments, a LNP enclosing mRNA encoding the base editor fusion protein is administered to a subject, followed by multiple administration or doses of a second LNP enclosing a guide RNA after 1 day, 2 days, 3 days, 4 days, 5 days, 6 days, 7 days, 2 weeks, 3 weeks, 4 weeks, 5 weeks, 6 weeks, 7 weeks, 8 weeks, 9 weeks, 10 weeks, 11 weeks, or 12 weeks or more. The multiple doses of the second LNP may be administered with intervals of 1, 2, 3, 4, 5, 6, 7, 8, 9, 10, 11, 12, 13, 14, 15, 16, 17, 18, 19, or 20 days or more.

In some embodiments, the ratio of the guide polynucleotide and the nucleic acid encoding the base editor fusion protein is about 1:10 to about 10:1 by weight. In some embodiments, the ratio of the guide polynucleotide and the nucleic acid encoding the base editor fusion protein is about 1:1, 1.5:1, 2:1, 3:1, 4:1, 1:1.5, 1:2, 1:3, 1:4 or any ratio between 4:1 or 1:4 by weight. In some embodiments, the ratio of the guide polynucleotide and the nucleic acid encoding the base editor fusion protein can be determined by titration of the guide polynucleotide and the nucleic acid encoding the base editor fusion protein.

In some embodiments, the molar ratio of the guide polynucleotide and the nucleic acid encoding the base editor fusion protein is about 500:1 to about 1:500.

In some embodiments, the ratio of the guide polynucleotide and the nucleic acid encoding the base editor fusion protein is about 1000:1 to about 1:1000 by weight. In some embodiments, the ratio of the guide polynucleotide and the nucleic acid encoding the base editor fusion protein is about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of the guide polynucleotide and the nucleic acid encoding the base editor fusion protein is about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight. In some embodiments, the ratio of the guide polynucleotide and the nucleic acid encoding the base editor fusion protein is at least about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of the guide polynucleotide and the nucleic acid encoding the base editor fusion protein is at least about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight. In some embodiments, the ratio of the guide polynucleotide and the nucleic acid encoding the base editor fusion protein is at most about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of the guide polynucleotide and the nucleic acid encoding the base editor fusion protein is at most about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight.

In some embodiments, the molar ratio of the guide polynucleotide and the nucleic acid encoding the base editor fusion protein is about 10000:1 to about 1:10000. In some embodiments, the molar ratio of the guide polynucleotide and the nucleic acid encoding the base editor fusion protein is about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of the guide polynucleotide and the nucleic acid encoding the base editor fusion protein is at least about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1. In some embodiments, the molar ratio of the guide polynucleotide and the nucleic acid encoding the base editor fusion protein is at least about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of the guide polynucleotide and the nucleic acid encoding the base editor fusion protein is at most about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of the guide polynucleotide and the nucleic acid encoding the base editor fusion protein is at most about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1.

In some embodiments, the ratio of a nucleic acid encoding the guide polynucleotide and the nucleic acid encoding the base editor fusion protein is about 10:1 to about 1:10 by weight. In some embodiments, the ratio of a nucleic acid encoding the guide polynucleotide and the nucleic acid encoding the base editor fusion protein is about 4:1, 3:1, 2:1, 1.5:1, 1:1, 1:1.5, 1:2, 1:3, or 1:4 by weight. In some embodiments, the molar ratio of a nucleic acid encoding the guide polynucleotide and the nucleic acid encoding the base editor fusion protein is about 500:1 to about 1:500.

In some embodiments, the ratio of a nucleic acid encoding the guide polynucleotide and the nucleic acid encoding the base editor fusion protein is about 1000:1 to about 1:1000 by weight. In some embodiments, the ratio of a nucleic acid encoding the guide polynucleotide and the nucleic acid encoding the base editor fusion protein is about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of a nucleic acid encoding the guide polynucleotide and the nucleic acid encoding the base editor fusion protein is about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight. In some embodiments, the ratio of a nucleic acid encoding the guide polynucleotide and the nucleic acid encoding the base editor fusion protein is at least about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of a nucleic acid encoding the guide polynucleotide and the nucleic acid encoding the base editor fusion protein is at least about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight. In some embodiments, the ratio of a nucleic acid encoding the guide polynucleotide and the nucleic acid encoding the base editor fusion protein is at most about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of a nucleic acid encoding the guide polynucleotide and the nucleic acid encoding the base editor fusion protein is at most about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight.

In some embodiments, the molar ratio of a nucleic acid encoding the guide polynucleotide and the nucleic acid encoding the base editor fusion protein is about 10000:1 to about 1:10000. In some embodiments, the molar ratio of a nucleic acid encoding the guide polynucleotide and the nucleic acid encoding the base editor fusion protein is about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of a nucleic acid encoding the guide polynucleotide and the nucleic acid encoding the base editor fusion protein is at least about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1. In some embodiments, the molar ratio of a nucleic acid encoding the guide polynucleotide and the nucleic acid encoding the base editor fusion protein is at least about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of a nucleic acid encoding the guide polynucleotide and the nucleic acid encoding the base editor fusion protein is at least about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1. In some embodiments, the molar ratio of a nucleic acid encoding the guide polynucleotide and the nucleic acid encoding the base editor fusion protein is at most about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of a nucleic acid encoding the guide polynucleotide and the nucleic acid encoding the base editor fusion protein is at most about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1.

Precision genome editing is a growing field with industrial, agricultural, and biomedical applications. One of the dominant genome-editing systems available today is clustered regularly interspaced short palindromic repeats (CRISPR)-CRISPR associated 9 (Cas9). Through the use of a guide RNA (gRNA) with a sequence homologous to that of a sequence of DNA in the target genome (known as the protospacer) adjacent to a specific protospacer-adjacent motif (PAM) comprising the sequence NGG (N is any standard base) in the DNA, Cas9 can be used to create a double-strand break (DSB) at the targeted sequence. Non-homologous end joining (NHEJ) at DSBs can be used to create indels and knock out genes at genetic loci; likewise, homology-directed repair (HDR) can be used, with an introduced template DNA, to insert genes or modify the targeted sequence. A variety of Cas9-based tools have been developed in recent years, including tools that methylate DNA, recognize broader sequence space, or create single-strand nicks. In 2016, Komor et al. described the use of CRISPR-Cas9 to convert a cytosine base to a thymine base without the introduction of a template DNA strand and without the need for DSBs (Komor A C, Kim Y B, Packer M S, et al. Programmable editing of a target base in genomic DNA without double-stranded DNA cleavage. *Nature*, 2016, 533: 420-4, incorporated herein by reference in its entirety). After the cytidine deaminase domain of rat APOBEC1 was fused to the N-terminus of catalytically-dead Cas9 (dCas9) using the linker XTEN (resulting in a fusion protein called base editor 1, or BE1), conversion of cytosine to uracil was observed between position 4 and position 8 within the 20-nt protospacer region of DNA (or, to express it a different way, 13 to 17 nucleotides upstream of the PAM). Of note, any cytosine base within this "window" was amenable to editing, resulting in varied outcomes depending on how many and which cytosines were edited. After DNA replication or repair, each uracil was replaced by a thymine, completing the C to T base editing.3 The next version of base editor (BE2) incorporated a uracil glycosylase inhibitor fused to the C-terminus of dCas9 to help inhibit base excision repair of the uracil bases resulting from the cytidine deaminase activity (which otherwise would act to restore the original cytosine bases); this improved the efficiency of C to T base editing. The final version, BE3, used a Cas9 nickase rather than dCas9; the nickase cut the unedited strand opposite the edited C to T bases, stimulating the removal of the opposing guanidine through eukaryotic mismatch repair. BE2 and BE3 base editing was observed in both human and murine cell lines. The specificity of base editing has been further improved through the addition of mutations to the Cas9 nickase; in similar fashion, Cas9 has been mutated to narrow the width of the editing window from approximately 5 nucleotides to as little as 1-2 nucleotides (Rees H A, Komor A C, Yeh W H, et al. Improving the DNA specificity and applicability of base editing through protein engineering and protein delivery. Nat Commun, 2017, 8: 15790, Kim Y B, Komor A C, Levy J M, et al. Increasing the genome-targeting scope and precision of base editing with engineered Cas9-cytidine deaminase fusions. Nat Biotechnol, 2017, 35: 371-6, each of which is incorporated herein by reference in its entirety).

An alternative cytosine base editing platform is by linking the activation-induced cytosine deaminase domain PmCDA1 to dCas9 (Target-AID), they were able to demonstrate targeted C to T base editing in yeast. Furthermore, an alternative C to T editing strategy was also demonstrated without fusing a deaminase domain to Cas9; instead, a SH3 (Src 3 homology) domain was added to the C-terminus of dCas9 while a SHL (SH3 interaction ligand) was added to PmCDA1.6 Optimization of efficiency was achieved through the use of a Cas9 nickase rather than dCas9. Further, an uracil DNA glycosylase inhibitor was added to enhance base editing in the mammalian CHO cell line. The resulting platform was able to consistently edit bases within 3 to 5 bases of the 18th nucleotide upstream of the PAM sequence (Nishida K, Arazoe T, Yachie N, et al. Targeted nucleotide editing using hybrid prokaryotic and vertebrate adaptive immune systems. Science, 2016, 353: aaf8729, incorporated herein by reference in its entirety).

A distinct cytosine base editing platform used Cpf1 (also known as Cas12a) instead of Cas9 as the RNA-guided endonuclease. Catalytically-inactive Cpf1 was fused to APOBEC1 (dLbCpf1-BE0), leading to C to T conversion in a human cell line. While the Cas9 base editor variants BE3 and Target-AID recognize the PAM sequence NGG, dLbCpf1-BE0 recognizes the T-rich PAM sequence TTTV. Although base editing was observed between positions 8 and 13 of the protospacer sequence with dLbCpf1-BE0, the introduction of additional mutations into Cpf1 was able to reduce the window to positions 10 to 12. However, narrowing of the base editing window correlated with a decrease in editing efficiency (Li X, Wang Y, Liu Y, et al. Base editing with a Cpf1-cytidine deaminase fusion. Nat Biotechnol, 2018, 36: 324-7, incorporated herein by reference in its entirety).

Cytosine base editing is not wholly predictable; indels can occur at the target site, albeit at lower frequencies that those observed for C to T editing editors. Furthermore, cytosine base editors can occasionally cause C to A or C to G edits rather than the expected C to T edits. Adding linker lengths between Cas9 nickase and the rat APOBEC1 cytosine deaminase domain from 16 amino acids to 32 amino acids, the linker between the Cas9 nickase and the uracil glycosylase inhibitor from 4 amino acids to 9 amino acids, and using a second uracil glycosylase inhibitor was appended to the C-terminus of the new cytosine base editor using another 9 amino acid linker improved cytosine base editor termed "BE4" (Komor A C, Zhao K T, Packer M S, et al. Improved base excision repair inhibition and bacteriophage Mu Gam protein yields C:G-to-T:A base editors with higher efficiency and product purity. Sci Adv, 2017, 3: eaao4774. Incorporated herein by reference in its entirety).

By fusing *Escherichia coli* adenine tTNA deaminase TadA (ecTadA) to dCas9 and mutagenesis of the ecTadA domain in conjunction with selection for editing activity revealed that A106V and D108N mutations yielded a base editor capable of editing adenine to guanine in DNA, termed ABE7.10 (Gaudelli N M, Komor A C, Rees H A, et al. Programmable base editing of A·T to G·C in genomic DNA without DNA cleavage. Nature, 2017, 551:464-71. Incorporated herein by reference in its entirety). Koblan et al. improved the efficiency of ABE7.10 through modification of nuclear localization signals and codon optimization, yielding a version called ABEmax; a similar approach improved the efficiency of the cytosine base editor BE4.10 Huang et al. performed further development of both adenine and cytosine base editors to use alternative PAMs and to expand their editing windows, thereby increasing their targeting range (Improving cytidine and adenine base editors by expression optimization and ancestral reconstruction. Nat Biotechnol, 2018, 36: 843-6, Incorporated herein by reference in its entirety).

The same has proven to be true of base editors, 12-14 although comparisons of Cas9, cytosine base editors, and adenine base editors using the same gRNAs have shown distinct off-target profiles.

A variety of studies have raised concern about gRNA-independent off-target base editing, caused by the deaminase domain acting in isolation (without the need for engagement of DNA by the Cas9-gRNA complex). Additional studies showed that the gRNA-independent off-target effects of base editors are not limited to DNA. RNA sequencing of cells treated with either cytosine base editors or adenine base editors revealed transcriptome-wide off-target editing of RNA, and that introduction of amino acid substitution in the deaminase domain of adenine base (e.g. R106W) editors reduced off-target editing of RNA without substantially reducing on-target DNA base-editing efficiency. Zuo E, Sun Y, Wei W, et al. Cytosine base editor generates substantial off-target single-nucleotide variants in mouse embryos. Science, 2019, 364: 289-92; Jin S, Zong Y, Gao Q, et al. Cytosine, but not adenine, base editors induce genome-wide off-target mutations in rice. Science, 2019, 364: 292-5; Grunewald J, Zhou R, Garcia S P, et al. Transcriptome-wide off-target RNA editing induced by CRISPR-guided DNA base editors. Nature, 2019, 569: 433-7; Grunewald J, Zhou R, Iyer S, et al. CRISPR DNA base editors with reduced RNA off-target and self-editing activities. Nat Biotechnol, 2019, 37: 1041-8; Zhou C, Sun Y, Yan R, et al. Off-target RNA mutation induced by DNA base editing and its elimination by mutagenesis. Nature, 2019, 571:275-8; Rees H A, Wilson C, Doman J L, et al. Analysis and minimization of cellular RNA editing by DNA adenine base editors. Sci Adv, 2019, 5: eaax5717, each of which is incorporated herein by reference in its entirety).

Correction of disease-causing mutations via precision editing with standard Cas9 genome editing has largely required HDR. Since HDR is limited to cells in S or G2 phase of mitosis, precision editing of non-mitotic cells is difficult. However, base editors are not reliant on HDR; the editing of postmitotic cochlear cells in mice is feasible with cytosine base editor BE3. By injecting BE3 and a gRNA in the form of a preassembled ribonucleoprotein via cationic liposomes, serine-33 in beta-catenin was edited to phenyl-alanine (TCT codon edited to TTT), allowing for the transdifferentiation of supporting cells into hair cells. Base editing of cochlear tissue was confirmed via sequencing, showing an editing rate between 0.7% and 3.0% depending on the region of the cochlea. In contrast, standard Cas9 editing via HDR showed negligible signs of efficacy in cochlear cells. A variant of SaBE3, delivered into the liver via adeno-associated viral (AAV) vectors, was reported to directly correct a pathogenic T to C mutation in the Pah gene with an editing rate as high as 29% and thereby treat the disease phenylketonuria in adult mice. Adenine base editing has also been demonstrated to generate mutations in mice. Yeh W H, Chiang H, Rees H A, et al. In vivo base editing of post-mitotic sensory cells. Nat Commun, 2018, 9: 2184; Villiger L, Grisch-Chan H M, Lindsay H, et al. Treatment of a metabolic liver disease by in vivo genome base editing in adult mice. Nat Med, 2018, 24: 1519-25; Ryu S M, Koo T, Kim K, et al. Adenine base editing in mouse embryos and an adult mouse model of Duchenne muscular dystrophy. Nat Biotechnol, 2018, 36: 536-9; Song C Q, Jiang T, Richter M, et al. Adenine base editing in an adult mouse model of tyrosinaemia. Nat Biomed Eng, 2020, 4: 125-30; Pisciotta L, Favari E, Magnolo L, et al. Characterization of three kindreds with familial combined hypolipidemia caused by loss-of-function mutations of ANGPTL3. Circ Cardiovasc Genet, 2012, 5: 42-50. each of which is incorporated herein by reference in its entirety.

Provided herein are compositions of nucleobase editor systems that comprises nucleobase editor proteins, complexes, or compounds that is capable of making a modification or conversion to a nucleobase (e.g., A, T, C, G, or U) within a target nucleotide sequence.

A nucleobase editor or a base editor (BE) refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating an adenine (A) in DNA.

In some embodiments, the base editor comprises a fusion protein comprising a programmable DNA binding protein fused to an adenosine deaminase. In some embodiments, the base editor comprises a fusion protein comprising a Cas9 protein and an adenosine deaminase. In some embodiments, the base editor is a Cas9 nickase (nCas9) fused to an adenosine deaminase. In some embodiments, the base editor is a nuclease-inactive Cas9 (dCas9) fused to an adenosine deaminase. In some embodiments, the base editor comprises a fusion protein comprising a programmable DNA binding protein fused to an cytidine deaminase. In some embodiments, the base editor comprises a fusion protein comprising a Cas9 protein and an cytidine deaminase. In some embodiments, the base editor is a Cas9 nickase (nCas9) fused to an cytidine deaminase. In some embodiments, the base editor is a nuclease-inactive Cas9 (dCas9) fused to an cytidine deaminase. In some embodiments, the base editor further comprises, an inhibitor of base excision repair, for example, a UGI domain. In some embodiments, the fusion protein comprises a Cas9 nickase fused to a deaminase and an inhibitor of base excision repair, such as a UGI or dISN domain. In some embodiments, the dCas9 domain of the fusion protein comprises a D10A and a H840A mutation as numbered in the wild type SpCas9 amino acid sequence. In some embodiments, the UGI comprises the following amino acid sequence:

>sp|P14739|UNGI_BPPB2 Uracil-DNA glycosylase inhibitor (SEQ ID NO: 16)
MTNLSDIIEKETGKQLVIQESILMLPEEVEEVIGNKPESDILVHTAYD

ESTDENVMLLTS D APE YKPW ALVIQDS NGENKIKML

In some embodiments, a base editor system provided herein comprises a base editor fusion protein. For example, a base editor fusion protein may comprise a programmable DNA binding protein and a deaminase, e.g. an adenosine deaminase. In some embodiments, any of the fusion proteins provided herein are base editors. In some embodiments, the programmable DNA binding protein is a Cas9 domain, a Cpf1 domain, a CasX domain, a CasY domain, a Cas12b domain, a C2c2 domain, aC2c3 domain, or an Argonaute domain. In some embodiments, the programmable DNA binding protein is a Cas9 domain. The Cas9 domain may be any of the Cas9 domains or Cas9 proteins (e.g., nuclease inactive Cas9 or Cas9 nickase, or a Cas9 variant from any species) provided herein. In some embodiments, any of the Cas9 domains or Cas9 proteins provided herein may be fused with any of the deaminases provided herein. In some embodiments, the base editor comprises a deaminase, e.g., an adenosine deaminase and a programmable DNA binding protein, e.g., a Cas9 domain joined via a linker. In some embodiments, the base editor comprises a fusion protein comprising a deaminase, e.g., an adenosine deaminase and a programmable DNA binding protein, e.g., a Cas9 domain joined via a linker. In some embodiments, the linker is a peptide linker. In some embodiments, a linker is present between the deaminase domain and the Cas9 domain. In some embodiments, an deaminase and a programmable DNA binding domain are fused via any of the peptide linkers provided herein. For example, an adenosine deaminase and a Cas9 domain may be fused via a linker that comprises between 1 and 200 amino acids. In some embodiments, the adenosine deaminase and the programmable DNA binding protein are fused via a linker that comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, the adenosine deaminase and the programmable DNA binding protein are fused via a linker that comprises 4, 16, 32, or 104 amino acids in length. In some embodiments, the adenosine deaminase and the programmable DNA binding protein are fused via a linker that comprises the amino acid sequence of SGSETPGTSESAT-PES (SEQ ID NO: 17), SGGS (SEQ ID NO: 18),
SGGSSGSETPGTSESATPESSGGS (SEQ ID NO: 19),
SGGSSGGSSGSETPGTSESATPESSGGSSGGS (SEQ ID NO: 20), or
GGSGGSPGSPAGSPTSTEEGTSESATPESGPGT-
STEPSEGSAPGSPAGSPTSTEEGTSTE
PSEGSAPGTSTEPSEGSAPGTSESAT-
PESGPGSEPATSGGSGGS (SEQ ID NO: 21). In some embodiments, the adenosine deaminase and the programmable DNA binding protein are fused via a linker comprising the amino acid sequence SGSETPGTS-ESATPES (SEQ ID NO: 17), which may also be referred to as the XTEN linker. In some embodiments, the linker is 24 amino acids in length. In some embodiments, the linker comprises the amino acid sequence SGGSSGGSSGSETPGTSESATPES (SEQ ID NO: 23). In some embodiments, the linker is 40 amino acids in length. In some embodiments, the linker comprises the amino acid sequence SGGSSGGSSGSETPGTS-ESATPESSGGSSGGSSGGSSGGS (SEQ ID NO: 24).

In some embodiments, the linker is 64 amino acids in length. In some embodiments, the linker comprises the amino acid sequence SGGSSGGSSGSETPGTSESAT-PESSGGSSGGSSGGSSGGSSGGSSGSETPGTSESAT-PESSGGS SGGS (SEQ ID NO: 25). In some embodiments, the linker is 92 amino acids in length. In some embodiments, the linker comprises the amino acid sequence PGSPAGSPT-STEEGTSESATPESGPGTSTEPSEGSAPGSPAGSPT-STEEGTSTEPSEGSAP GTSTEPSEGSAPGTSESAT-PESGPGSEPATS (SEQ ID NO: 26).

In some embodiments, a base editor system provided herein comprises a base editor comprising a fusion protein comprising an inhibitor of base repair. In some embodiments, a base editor comprises a fusion protein comprising a cytidine deaminase and a programmable DNA binding domain, e.g. a Cas9 domain. In some embodiments, a base editor comprises a fusion protein comprising an adenosine deaminase and a programmable DNA binding domain, e.g. a Cas9 domain. In some embodiments, the base editor or the fusion protein further comprises an inhibitor of base repair (IBR). In some embodiments, the IBR comprises an inhibitor of inosine base repair. In some embodiments, the IBR is an inhibitor of inosine base excision repair. In some embodiments, the inhibitor of inosine base excision repair is a catalytically inactive inosine specific nuclease (dISN). In some embodiments, a dISN may inhibit (e.g., by steric hindrance) inosine removing enzymes from excising the inosine residue from DNA. For example, catalytically dead inosine glycosylases (e.g., alkyl adenine glycosylase [AAG]) will bind inosine but will not create an abasic site or remove the inosine, thereby sterically blocking the newly-formed inosine moiety from potential DNA damage/repair mechanisms. Thus, this disclosure contemplates a fusion protein comprising a programmable DNA binding protein and an adenosine deaminase further fused to a dISN. This disclosure contemplates a fusion protein comprising any Cas9 domain, for example, a Cas9 nickase (nCas9) domain, a catalytically inactive Cas9 (dCas9) domain, a high fidelity Cas9 domain, or a Cas9 domain with reduced PAM exclusivity. It should be understood that the use of a dISN may increase the editing efficiency of a adenosine deaminase that is capable of catalyzing a A to I change. For example, fusion proteins comprising a dISN domain may be more efficient in deaminating A residues.

In some embodiments, the base editors provided herein comprise fusion proteins that further comprise one or more nuclear targeting sequences, for example, a nuclear localization sequence (NLS). In some embodiments, the fusion protein comprises multiple NLSs. In some embodiments, the fusion protein comprises a NLS at the N-terminus and the C-terminus of the fusion protein. In some embodiments, a NLS comprises an amino acid sequence that facilitates the importation of a protein, that comprises an NLS, into the cell nucleus. In some embodiments, the NLS is fused to the N-terminus of the fusion protein. In some embodiments, the NLS is fused to the C-terminus of the fusion protein. In some embodiments, the NLS is fused to the N-terminus of the programmable DNA binding protein, e.g. the Cas9. In some embodiments, the NLS is fused to the C-terminus of the programmable DNA binding protein. In some embodiments, the NLS is fused to the N-terminus of the adenosine deaminase. In some embodiments, the NLS is fused to the C-terminus of the adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, a NLS comprises the amino acid sequence PKKKRKV (SEQ ID NO: 27) or MD SLLMNRRKFLY-QFKNVRWAKGRRETYLC (SEQ ID NO: 28). Additional nuclear localization sequences are known in the art and would be apparent to the skilled artisan. For example, NLS sequences are described in Plank et ah, PCT/EP2000/011690, the contents of which are incorporated herein by reference for their disclosure of exemplary nuclear localization sequences.

In some embodiments, the fusion proteins provided herein do not comprise a linker. In some embodiments, a linker is present between one or more of the domains or proteins (e.g., adenosine deaminase, napDNAbp, NLS, and/or IBR). In some embodiments, the "-" used in the general architecture above indicates the presence of an optional linker.

Some aspects of the disclosure provide base editors or fusion proteins that comprise a programmable DNA binding protein and at least two adenosine deaminase domains. Without wishing to be bound by any particular theory, dimerization of adenosine deaminases (e.g., in cis or in trans) may improve the ability (e.g., efficiency) of the fusion protein to modify a nucleic acid base, for example to deaminate adenine. In some embodiments, any of the fusion proteins may comprise 2, 3, 4 or 5 adenosine deaminase domains. In some embodiments, any of the fusion proteins provided herein comprise two adenosine deaminases. In some embodiments, any of the fusion proteins provided herein contain only two adenosine deaminases. In some embodiments, the adenosine deaminases are the same. In some embodiments, the adenosine deaminases are any of the adenosine deaminases provided herein. In some embodiments, the adenosine deaminases are different. In some embodiments, the first adenosine deaminase is any of the adenosine deaminases provided herein, and the second adenosine is any of the adenosine deaminases provided herein, but is not identical to the first adenosine deaminase. In some embodiments, the first adenosine deaminase comprises any one of the mutations provided herein as numbered in SEQ ID NO: 1. In some embodiments, the second adenosine deaminase comprises any one of the mutations provided herein as numbered in SEQ ID NO: 1. In some embodiments, the first adenosine deaminase comprises any one of the mutations provided herein as numbered in SEQ ID NO: 1, and the second adenosine deaminase comprises a wild type adenosine deaminase sequence. In some embodiments, the second adenosine deaminase comprises any one of the mutations provided herein as numbered in SEQ ID NO: 1, and the first adenosine deaminase comprises a wild type adenosine deaminase sequence. As one example, the fusion protein may comprise a first adenosine deaminase and a second adenosine deaminase that both comprise a A106V, D108N, D147Y, and E155V mutation from ecTadA (SEQ ID NO: 1). As another example, the fusion protein may comprise a first adenosine deaminase domain that comprises a A106V, D108N, D147Y, and E155V mutation from ecTadA (SEQ ID NO: 1), and a second adenosine deaminase that comprises a L84F, A106V, D108N, H123Y, D147Y, E155V, and I156F mutation from ecTadA (SEQ ID NO: 1).

In some embodiments, the adenosine deaminase comprises the amino acid sequence:

```
                                        (SEQ ID NO: 1)
MSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIHSR
```

-continued
```
IGRVVFGARDAKTGAAGSLMDVLHHPGMNHRVEITEGILADECAALLSD

FFRMRRQEIKAQKKAQSSTD
```

In some embodiments, the fusion protein comprises two adenosine deaminases (e.g., a first adenosine deaminase and a second adenosine deaminase). In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker. In some embodiments, the linker is any of the linkers provided herein, for example, any of the linkers described in the "Linkers" section. In some embodiments, the first adenosine deaminase is the same as the second adenosine deaminase. In some embodiments, the first adenosine deaminase and the second adenosine deaminase are any of the adenosine deaminases described herein. In some embodiments, the first adenosine deaminase and the second adenosine deaminase are different. In some embodiments, the first adenosine deaminase is any of the adenosine deaminases provided herein. In some embodiments, the second adenosine deaminase is any of the adenosine deaminases provided herein but is not identical to the first adenosine deaminase. In some embodiments, the first adenosine deaminase is an ecTadA adenosine deaminase. In some embodiments, the first adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the amino acid sequence set forth SEQ ID NO: 1 or to any of the adenosine deaminases provided herein. In some embodiments, the second adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the amino acid sequence set forth SEQ ID NO: 1 or to any of the adenosine deaminases provided herein. In some embodiments, the second adenosine deaminase comprises the amino acid sequence of SEQ ID NO: 1.

In some embodiments, the fusion proteins provided herein do not comprise a linker. In some embodiments, a linker is present between one or more of the domains or proteins (e.g., first adenosine deaminase, second adenosine deaminase, programmable DNA binding protein, and/or NLS).

It should be appreciated that the fusion proteins of the present disclosure may comprise one or more additional features. For example, in some embodiments, the fusion protein may comprise cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

In some embodiments, the fusion protein comprises an amino acid sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the amino acid sequences listed in Table 23.

In some embodiments, the fusion protein comprises any one of the amino acid sequences listed in Table 23. In some embodiments, the sequence of the fusion protein is any one of the amino acid sequences listed in Table 23. In some embodiments, the fusion protein comprises an amino acid sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the amino acid sequences of SEQ ID NOs: 2137, 2149, 2154, 2158, 2188, 2140, 40, 2146, 2152, 2156, and 2160. In some embodiments, the fusion protein comprises any one of the amino acid sequences of SEQ ID NOs: 2137, 2149, 2154, 2158, 2188, 2140, 40, 2146, 2152, 2156, and 2160. In some embodiments, the sequence of the fusion protein is any one of the amino acid sequences of SEQ ID NOs: 2137, 2149, 2154, 2158, and 2188.

In some embodiments, the fusion protein is encoded by the polynucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences listed in Table 23. In some embodiments, the fusion protein is encoded by any one of the polynucleotide sequences listed in Table 23. In some embodiments, the fusion protein is expressed by the polynucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences listed in Table 23. In some embodiments, the fusion protein is expressed by any one of the polynucleotide sequences listed in Table 23. In some embodiments, the fusion protein is encoded by the polynucleotide sequence that comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, and 2190. In some embodiments, the fusion protein is encoded by the polynucleotide sequence that comprises any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, and 2190. In some embodiments, the fusion protein is encoded by any one of the polynucleotide sequences of SEQ ID NOs: 2192, 2148, 2153, 2157, 2161, 2168, 2174, 2180, 2186, and 2189. In some embodiments, the fusion protein is expressed by the polynucleotide sequence that comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, 2190, 2138, 2147, 2158, or a combination thereof. In some embodiments, the fusion protein is encoded by the polynucleotide sequence that comprises any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, 2190, 2138, 2147, 2158, or a combination thereof. In some embodiments, the fusion protein is expressed by any one of the polynucleotide sequences of SEQ ID NOs: 2192, 2148, 2153, 2157, 2161, 2168, 2174, 2180, 2186, and 2189. In some embodiments, the polynucleotide sequence further comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2138, 2147, 2158, or a combination thereof. In some embodiments, the polynucleotide sequence further comprises any one of the polynucleotide sequences of SEQ ID NOs: 2138, 2147, 2158, or a combination thereof.

In some embodiments, the nucleobase editor ABE8.8 comprises a fusion protein comprising the sequence as provided below:

(SEQ ID NO: 3)
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHHPGMNHRVEITEGILADECAALLCR

FFRMPRRVFNAQKKAQSSTDSGGSSGGSSGSETPGTSESATPESSGGSS

GGSDKKYSIGLAIGTNSVGWAVITDEYKVPSKKFKVLGNTDRHSIKKNL

IGALLFDSGETAEATRLKRTARRRYTRRKNRICYLQEIFSNEMAKVDDS

FFHRLEESFLVEEDKKHERHPIFGNIVDEVAYHEKYPTIYHLRKKLVDS

TDKADLRLIYLALAHMIKFRGHFLIEGDLNPDNSDVDKLFIQLVQTYNQ

LFEENPINASGVDAKAILSARLSKSRRLENLIAQLPGEKKNGLFGNLIA

LSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQ

QLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREK

IEKILTFRIPYYVGPLARGNSRFAWMTRKSEETITPWNFEEVVDKGASA

QSFTERMTNFDKNLPNEKVLPKHSLLYEYFTVYNELTKVKYVTEGMRKP

AFLSGEQKKAIVDLLFKTNRKVTVKQLKEDYFKKIECFDSVEISGVEDR

FNASLGTYHDLLKIIKDKDFLDNEENEDILEDIVLTLTLFEDREMIEER

LKTYAHLFDDKVMKQLKRRRYTGWGRLSRKLINGIRDKQSGKTILDFLK

SDGFANRNFMQLIHDDSLTFKEDIQKAQVSGQGDSLHEHIANLAGSPAI

KKGILQTVKVVDELVKVMGRHKPENIVIEMARENQTTQKGQKNSRERMK

RIEEGIKELGSQILKEHPVENTQLQNEKLYLYYLQNGRDMYVDQELDIN

RLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITK
HVAQILDSRMNTKYDENDKLIREVKVITLKSKLVSDFRKDFQFYKVREI
NNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDK
GRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSF
EKNPIDFLEAKGYKEVKKDLIIKLPKYSLFELENGRKRMLASAGELQKG
NELALPSKYVNFLYLASHYEKLKGSPEDNEQKQLFVEQHKHYLDEIIEQ
ISEFSKRVILADANLDKVLSAYNKHRDKPIREQAENIIHLFTLTNLGAP
AAFKYFDTTIDRKRYTSTKEVLDATLIHQSITGLYETRIDLSQLGGD

In some embodiments, the nucleobase editor comprises a fusion protein comprising a polypeptide encoded by the polynucleotide (herein also referenced as MA002) sequence as provided below:

(SEQ ID NO: 4)
ATGAGCGAGGTCGAGTTCTCTCACGAATATTGGATGAGACACGCTCTCA
CCCTGGCTAAGAGAGCCAGGGACGAAAGAGAGGTGCCAGTTGGCGCTGT
CCTGGTGTTGAACAATCGCGTCATCGGAGAAGGATGGAATCGCGCCATT
GGCCTGCACGATCCAACCGCACATGCCGAATTATGGCTCTGCGGCAAG
GCGGCCTCGTGATGCAAAATTACAGACTGATCGATGCTACCCTCTACGT
CACCTTCGAGCCCTGTGTCATGTGTGCTGGGGCAATGATTCACTCCCGG
ATTGGCCGCGTGGTGTTTGGAGTGCGGAATGCCAAGACTGGCGCCGCTG
GATCTCTGATGGACGTCCTGCACcatCCTGGGATGAACCACCGGGTCGA
GATCACAGAGGGAATTCTGGCTGACGAGTGCGCTGCCCTGCTGTGCagg
TTCTTTAGAATGCCtAGAaggGTGTTCAACGCCCAGAAAAAGCTCAGA
GCAGCACCGATTCCGGCGGAAGCAGCGGAGGATCTTCTGGAAGCGAAAC
CCCAGGCACCAGCGAGTCTGCCACACCAGAATCATCTGGCGGTAGCTCC
GGCGGCAGCGACAAGAAGTATTCTATCGGACTGGCCATCGGCACCAACT
CTGTTGGATGGGCCGTGATCACCGACGAGTACAAGGTGCCCAGCAAGAA
ATTCAAGGTGCTGGGCAACACCGACAGGCACAGCATCAAGAAGAACCTG
ATCGGCGCACTGCTGTTCGACTCTGGCGAAACAGCCGAGGCCACCAGAC
TGAAGAGAACAGCCCGCAGACGGTACACCAGAAGAAAGAACCGGATCTG
CTACCTCCAAGAGATCTTCAGCAACGAGATGGCCAAGGTGGACGACAGC
TTCTTCCACAGACTGGAAGAGTCCTTCCTGGTGGAAGAGGACAAGAAGC
ACGAGAGACACCCCATCTTCGGCAACATCGTGGACGAGGTGGCCTACCA
CGAGAAGTACCCCACCATCTACCACCTGAGAAAGAAACTGGTGGACAGC
ACCGACAAGGCCGACCTGAGACTGATCTATCTGGCCCTGGCTCACATGA
TCAAGTTCCGGGGCCACTTCCTGATCGAGGGCGACCTGAATCCTGACAA
CAGCGACGTGGACAAGCTGTTCATCCAGCTGGTGCAGACCTACAACCAG
CTGTTCGAGGAAAACCCCATCAACGCCAGCGGAGTGGATGCCAAGGCCA
TCCTGTCTGCCAGACTGAGCAAGAGCAGACGGCTGGAAAATCTGATCGC
CCAGCTGCCTGGCGAGAAGAAGAATGGCCTGTTCGGCAACCTGATTGCC
CTGAGCCTGGGCCTGACACCTAACTTCAAGAGCAACTTCGACCTGGCCG
AGGACGCCAAACTGCAGCTGAGCAAGGACACCTACGACGACGACCTGGA
CAATCTGCTGGCCCAGATCGGCGATCAGTACGCCGACTTGTTTCTGGCC
GCCAAGAATCTGAGCGACGCCATCCTGCTGTCCGACATCCTGAGAGTGA
CACCGAGATCACCAAGGCACCTCTGAGCGCCTCTATGATCAAGAGATAC
GACGAGCACCACCAGGATCTGACCCTGCTGAAGGCCCTCGTTAGACAGC
AGCTGCCAGAGAAGTACAAAGAGATTTTCTTCGACCAGAGCAAGAACGG
CTACGCCGGCTACATTGATGGCGGAGCCAGCCAAGAGGAATTCTACAAG
TTCATCAAGCCCATCCTCGAGAAGATGGACGGCACCGAGGAACTGCTGG
TCAAGCTGAACAGAGAGGACCTGCTGAGAAAGCAGAGAACCTTCGACAA
CGGCAGCATCCCTCACCAGATCCACCTGGGAGAACTGCACGCCATTCTG
CGGAGACAAGAGGACTTTTACCCATTCCTGAAGGACAACCGGGAAAAGA
TCGAGAAAATCCTGACCTTCAGGATCCCCTACTACGTGGGACCACTGGC
CAGAGGCAATAGCAGATTCGCCTGGATGACCAGAAAGAGCGAGGAAACC
ATCACTCCCTGGAACTTCGAGGAAGTGGTGGACAAGGGCGCCAGCGCTC
AGTCCTTCATCGAGCGGATGACCAACTTCGATAAGAACCTGCCTAACGA
GAAGGTGCTGCCCAAGCACAGCCTGCTGTACGAGTACTTCACCGTGTAC
AACGAGCTGACCAAAGTGAAATACGTGACCGAGGGAATGAGAAAGCCCG
CCTTTCTGAGCGGCGAGCAGAAAAAGGCCATCGTGGATCTGCTGTTCAA
GACCAACCGGAAAGTGACCGTGAAGCAGCTGAAAGAGGACTACTTCAAG
AAAATCGAGTGCTTCGACAGCGTCGAGATCTCCGGCGTGGAAGATCGGT
TCAATGCCAGCCTGGGCACATACCACGATCTGCTGAAAATTATCAAGGA
CAAGGACTTCCTGGACAACGAAGAGAACGAGGACATCCTTGAGGACATC
GTGCTGACACTGACCCTGTTTGAGGACAGAGAGATGATCGAGGAACGGC
TGAAAACATACGCCCACCTGTTCGACGACAAAGTGATGAAGCAACTGAA
GCGGCGGAGATACACCGGCTGGGGCAGACTGTCTCGGAAGCTGATCAAC
GGCATCCGGGATAAGCAGTCCGGCAAGACCATCCTGGACTTTCTGAAGT
CCGACGGCTTCGCCAACAGAAACTTCATGCAGCTGATTCACGACGACAG
CCTCACCTTCAAAGAGGATATCCAGAAAGCCCAGGTGTCCGGCCAGGGC
GATTCTCTGCATGAGCACATTGCCAACCTGGCCGGCTCTCCCGCCATTA
AGAAAGGCATCCTGCAGACAGTGAAGGTGGTGGACGAGCTTGTGAAAGT
GATGGGCAGACACAAGCCCGAGAACATCGTGATCGAAATGGCCAGAGAG
AACCAGACCACACAGAAGGGACAGAAGAACAGCCGCGAGAGAATGAAGC
GGATCGAAGAGGGCATCAAAGAGCTGGGCAGCCAGATCCTGAAAGAACA
CCCCGTGGAAAACACCCAGCTGCAGAACGAGAAGCTGTACCTGTACTAC
CTGCAGAATGGACGGGATATGTACGTGGACCAAGAGCTGGACATCAACA
GACTGTCCGACTACGATGTGGACCATATCGTGCCCCAGTCTTTTCTGAA
GGACGACTCCATCGACAACAAGGTCCTGACCAGATCCGACAAGAATCGG
GGCAAGAGCGACAACGTGCCCTCCGAAGAGGTGGTCAAGAAGATGAAGA
ACTACTGGCGACAGCTGCTGAACGCCAAGCTGATTACCCAGCGGAAGTT

```
-continued
CGACAATCTGACCAAGGCCGAAAGAGGCGGCCTGAGCGAACTGGATAAG

GCCGGCTTCATCAAGAGACAGCTGGTGGAAACCCGGCAGATCACAAAGC

ACGTGGCACAGATTCTGGACTCTCGGATGAACACTAAGTACGACGAGAA

CGACAAACTGATCCGCGAAGTGAAAGTCATCACCCTGAAGTCCAAGCTG

GTGTCCGATTTCCGGAAGGATTTCCAGTTCTACAAAGTGCGCGAGATCA

ACAACTACCATCACGCCCACGACGCCTACCTGAATGCCGTTGTTGGAAC

AGCCCTGATCAAAAAGTACCCTAAGCTGGAAAGCGAGTTCGTGTACGGC

GACTACAAGGTGTACGACGTGCGGAAGATGATCGCCAAGAGCGAGCAAG

AGATTGGCAAGGCAACCGCCAAGTACTTCTTCTACAGCAACATCATGAA

CTTTTTCAAGACAGAGATCACCCTCGCCAACGGCGAGATCAGAAAGCGG

CCTCTGATCGAGACAAACGGCGAAACCGGCGAGATTGTGTGGGATAAGG

GCAGAGACTTTGCCACAGTGCGGAAAGTGCTGAGCATGCCCCAAGTGAA

TATCGTGAAGAAAACCGAGGTGCAGACAGGCGGCTTCAGCAAAGAGTCT

ATCCTGCCTAAGCGGAACTCCGACAAGCTGATCGCCAGAAAGAAGGACT

GGGACCCCAAGAAGTACGGCGGCTTCGATTCTCCTACCGTGGCCTATAG

CGTGCTGGTGGTGGCCAAAGTGGAAAAGGGCAAGTCCAAGAAACTCAAG

AGCGTGAAAGAGCTGCTGGGGATCACCATCATGGAAAGAAGCAGCTTCG

AGAAGAATCCGATCGATTTCCTCGAGGCCAAGGGCTACAAAGAAGTGAA

AAAGGACCTGATCATCAAGCTCCCCAAGTACTCCCTGTTCGAGCTGGAA

AACGGCCGGAAGAGAATGCTGGCCTCTGCTGGCGAACTGCAGAAGGGAA

ACGAACTGGCCCTGCCTAGCAAATATGTGAACTTCCTGTACCTGGCCAG

CCACTATGAGAAGCTGAAGGGCAGCCCCGAGGACAATGAGCAAAAGCAG

CTGTTTGTGGAACAGCACAAGCACTACCTGGACGAGATCATCGAGCAGA

TCAGCGAGTTTAGCAAGAGAGTGATTCTGGCCGACGCCAATCTGGACAA

AGTGCTGTCCGCCTACAACAAGCACCGGGACAAGCCTATCAGAGAGCAG

GCCGAGAATATCATCCACCTGTTTACCCTGACCAACCTGGGAGCCCCTG

CCGCCTTCAAGTACTTTGACACCACCATCGACCGGAAGCGGTACACCTC

CACCAAAGAGGTGCTGGACGCCACTCTGATCCACCAGTCTATCACCGGC

CTGTACGAGACACGGATCGACCTGTCTCAACTCGGAGGCGACGAAGGCG

CCGATAAGAGAACCGCCGATGGCTCTGAGTTCGAGAGCCCCAAGAAAAA

GCGCAAAGTG
```

In an aspect, a nucleobase editor system provided herein comprises a guide polynucleotide. In some embodiments, the guide polynucleotide binds and forms a complex with the base editor fusion protein. In some embodiments, the guide polynucleotide directs the base editor fusion protein to effect a modification at a target sequence. The guide polynucleotide may comprise a single nucleic acid sequence or two separate nucleic acid sequences. In some embodiments, the guide polynucleotide is a single guide, e.g. a single guide RNA. In some embodiments, the single guide RNA comprises a spacer sequence that is capable of hybridizing with a target sequence. In some embodiments, the single guide RNA comprises a tracrRNA sequence that binds the programmable DNA binding protein, e.g. the Cas9 protein of the base editor fusion protein. In some embodiments, the single guide RNA comprises a stem loop structure, a tracrRNA sequence, a crRNA sequence, a direct repeat, and/or an anti-repeat. In some embodiments, the single guide RNA comprises a chemical modification. In some embodiments, the guide polynucleotide is any one of the guide polynucleotides provided herein, as described in the "Guide polynucleotide" section.

Deaminase Domains

Disclosed herein are base editor systems for editing, modifying or altering a target nucleotide sequence of a polynucleotide.

A base editor system provided herein may comprise a programmable DNA binding protein and a deaminase. As used herein, a deaminase may refer to an enzyme that catalyzes the removal of an amine group from a molecule, or deamination, for example through hydrolysis. In some embodiments, the deaminase is a cytidine deaminase, catalyzing the deamination of cytidine (C) to uridine (U), deoxycytidine (dC) to deoxyuridine (dU), or 5-methylcytidine to thymidine (T, 5-methyl-U), respectively. Subsequent DNA repair mechanisms ensure that a dU is replaced by T, as described in Komor et al, Nature, Programmable editing of a target base in genomic DNA without double-stranded DNA cleavage, 533, 420-424 (2016), which is incorporated herein by reference in its entirety. In some embodiments, the deaminase is a cytosine deaminase, catalyzing and promoting the conversion of cytosine to uracil (e.g., in RNA) or thymine (e.g., in DNA). In some embodiments, the deaminase is an adenosine deaminase, catalyzing and promoting the conversion of adenine to guanine. In some embodiments, the deaminase is a naturally-occurring deaminase from an organism, such as a human, chimpanzee, gorilla, monkey, cow, dog, rat, or mouse. In some embodiments, the deaminase is a variant of a naturally-occurring deaminase from an organism, and the variants do not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase from an organism A cytidine deaminase (or cytosine deaminase) comprises an enzyme that catalyzes the chemical reaction "cytosine+ $H_2O \rightarrow$ uracil+$NH_3$" or "5-methyl-cytosine+ $H_2O \rightarrow$ thymine+$NH_3$." In the context of a gene, such nucleotide change, or mutation, may in turn lead to an amino acid change in the protein, which may affect the protein's function, e.g., loss-of-function or gain-of-function. Subsequent DNA repair mechanisms ensure that uracil bases in DNA are replaced by T, as described in Komor et al. (Nature, Programmable editing of a target base in genomic DNA without double-stranded DNA cleavage, 533, 420-424 (2016), which is incorporated herein by reference in its entirety).

One exemplary suitable class of cytosine deaminases is the apolipoprotein B mRNA-editing complex (APOBEC) family of cytosine deaminases encompassing eleven proteins that serve to initiate mutagenesis in a controlled and beneficial manner. The apolipoprotein B editing complex 3 (APOBEC3) enzyme provides protection to human cells against a certain HIV-1 strain via the deamination of cytosines in reverse-transcribed viral ssDNA. These cytosine deaminases all require a Zn-coordinating motif (His-X-Glu-X23_26-Pro-Cys-X2_4-Cys (SEQ ID NO: 29)) and bound water molecule for catalytic activity. The glutamic acid residue acts to activate the water molecule to a zinc hydroxide for nucleophilic attack in the deamination reaction. Each family member preferentially deaminates at its own particular "hotspot," for example, WRC (W is A or T, R is A or G) for hAID, or TTC for hAPOBEC3F. A recent crystal structure of the catalytic domain of APOBEC3G revealed a secondary structure comprising a five-stranded β-sheet core flanked by six α-helices, which is believed to be conserved across the entire family. The active center loops have been shown to be responsible for both ssDNA binding and in determining "hotspot" identity. Overexpression of these enzymes has been linked to genomic instability and cancer, thus highlighting the importance of sequence-specific targeting. Another suitable cytosine deaminase is the activation-induced cytidine deaminase (AID), which is responsible for the maturation of antibodies by converting cytosines in ssDNA to uracils in a transcription-dependent, strand-biased fashion.

An adenosine deaminase (or adenine deaminase) comprises an enzyme that catalyzes the hydrolytic deamination of adenosine or deoxy adenosine to inosine or deoxyinosine, respectively. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, E. coli, S. aureus, S. typhi, S. putrefaciens, H. influenzae, or C. crescentus. In some embodiments, the adenosine deaminase is a TadA deaminase. In some embodiments, the TadA deaminase is an E. coli TadA deaminase. In some embodiments, the TadA deaminase is a truncated E. coli TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the amino acid sequence set forth in SEQ ID NO:1 or to any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to the amino acid sequence set forth in SEQ ID NO:1 or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NO:1 or any of the adenosine deaminases provided herein.

In some embodiments, the adenosine deaminase comprises a D108X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in SEQ ID NO: 1, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A106V mutation in SEQ ID NO: 1, or a corresponding mutation in another adenosine deaminase.

In some embodiments, the adenosine deaminase comprises a E155X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in SEQ ID NO: 1, or a corresponding mutation in another adenosine deaminase.

In some embodiments, the adenosine deaminase comprises a D147X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in SEQ ID NO: 1, or a corresponding mutation in another adenosine deaminase.

It should be appreciated that any of the mutations provided herein (e.g., based on the ecTadA amino acid sequence of SEQ ID NO: 1) may be introduced into other adenosine deaminases, such as S. aureus TadA (saTadA), or other adenosine deaminases (e.g., bacterial adenosine deaminases). It would be apparent to the skilled artisan how to are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in ecTadA SEQ ID NO: 1, or a corresponding mutation in another adenosine deaminase. In some embodiments, an adenosine deaminase comprises the following group of mutations (groups of mutations are separated by a ";") in ecTadA SEQ ID NO: 1, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D 147Y; and D108N, A106V, E55V, and D147Y. It should be appreciated, however, that any combination of corresponding mutations provided herein may be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95I, V102A, F104L, A106V, R107C, or R107H, or R107P, D108G, or D108N, or D108V, or D108A, or D108Y, K110I, M118K, N127S, A138V, F149Y, M151V, R153C, Q154L, 1156D, and/or K157R mutation in SEQ ID NO: 1, or one or more corresponding mutations in another adenosine deaminase. In some embodiments, the adenosine deaminase comprises one or more of the mutations corresponding to SEQ ID NO: 1, or one or more corresponding mutations in another adenosine deaminase. In some embodiments, the adenosine deaminase comprises the mutation or mutations of in any constructs shown in Table 23 corresponding to SEQ ID NO: 1, or a corresponding mutation or mutations in another adenosine deaminase. In some embodiments, the adenosine deaminase comprises one or more of a H8X, D108X, and/or N127X mutation in SEQ ID NO: 1, or one or more corresponding mutations in another adenosine deaminase, where X indicates the presence of any amino acid. In some embodiments, the adenosine deaminase comprises one or more of a H8Y, D108N, and/or N127S mutation in SEQ ID NO: 1, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in SEQ ID NO: 1, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in SEQ ID NO: 1, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five mutations selected from the group consisting of H8X, D108X, N127X, E155X, and T166X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five mutations selected from the group consisting of H8X, D108X, A109X, N127X, and E155X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in SEQ ID NO: 1, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H in SEQ ID NO: 1, or a corresponding mutation or mutations in another adenosine deaminase. In some embodiments, the adenosine deaminase comprises one, two, three, four, or five mutations selected from the group consisting of H8Y, D108N, N127S, E155V, and T166P in SEQ ID NO: 1, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q in SEQ ID NO: 1, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V in SEQ ID NO: 1, or a corresponding mutation or mutations in another adenosine deaminase. In some embodiments, the adenosine deaminase comprises one, two, three, four, or five mutations selected from the group consisting of H8Y, D108N, A109T, N127S, and E155G in SEQ ID NO: 1, or a corresponding mutation or mutations in another adenosine deaminase.

In some embodiments, the adenosine deaminase comprises a D108N, D108G, or D108V mutation in SEQ ID NO: 1, or corresponding mutations in another adenosine deaminase. In some embodiments, the adenosine deaminase comprises a A106V and D108N mutation in SEQ ID NO: 1, or corresponding mutations in another adenosine deaminase. In some embodiments, the adenosine deaminase comprises R107C and D108N mutations in SEQ ID NO: 1, or corresponding mutations in another adenosine deaminase. In some embodiments, the adenosine deaminase comprises a H8Y, D108N, N127S, D147Y, and Q154H mutation in SEQ ID NO: 1, or corresponding mutations in another adenosine deaminase. In some embodiments, the adenosine deaminase comprises a H8Y, R24W, D108N, N127S, D147Y, and E155V mutation in SEQ ID NO: 1, or corresponding mutations in another adenosine deaminase. In some embodiments, the adenosine deaminase comprises a D108N, D147Y, and E155V mutation in SEQ ID NO: 1, or corresponding mutations in another adenosine deaminase. In some embodiments, the adenosine deaminase comprises a H8Y, D108N, and S 127S mutation in SEQ ID NO: 1, or corresponding mutations in another adenosine deaminase. In some embodiments, the adenosine deaminase comprises a A106V, D108N, D147Y and E155V mutation in SEQ ID NO: 1, or corresponding mutations in another adenosine deaminase.

In some embodiments, the adenosine deaminase comprises one or more of a S2X, H8X, I49X, L84X, H123X, N127X, I156X and/or K160X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation in SEQ ID NO: 1, or one or more corresponding mutations in another adenosine deaminase. In some embodiments, the adenosine deaminase comprises one or more of the mutations in SEQ ID NO: 1, or one or more corresponding mutations in another adenosine deaminase. In some embodiments, the adenosine deaminase comprises the mutation or mutations of any one of clones corresponding to SEQ ID NO: 1, or a corresponding mutation or mutations in another adenosine deaminase.

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in SEQ ID NO: 1, or a corresponding mutation in another adenosine deaminase.

In some embodiments, the adenosine deaminase comprises an H123X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H123Y mutation in SEQ ID NO: 1, or a corresponding mutation in another adenosine deaminase.

In some embodiments, the adenosine deaminase comprises an I157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an I157F mutation in SEQ ID NO: 1, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and 1156X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five mutations selected from the group consisting of H8X, A106X, D108X, N127X, and K160X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and 1156F in SEQ ID NO: 1, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in SEQ ID NO: 1, or a corresponding amino acid in another adenosine deaminase. In some embodiments, the adenosine deaminase comprises one, two, three, four, or five mutations selected from the group consisting of H8Y, A106T, D108N, N127S, and K160S in SEQ ID NO: 1, or a corresponding mutation or mutations in another adenosine deaminase. In some embodiments, the adenosine deaminase comprises one or more of a E25X, R26X, R107X, A142X, and/or A143X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in SEQ ID NO: 1, or one or more corresponding mutations in another adenosine deaminase. In some embodiments, the adenosine deaminase comprises one or more of the mutations provided in Table 23 corresponding to SEQ ID NO: 1, or one or more corresponding mutations in another adenosine deaminase. In some embodiments, the adenosine deaminase comprises the mutation or mutations of any one shown in Table 23 corresponding to SEQ ID NO: 1, or a corresponding mutation or mutations in another adenosine deaminase.

In some embodiments, the adenosine deaminase comprises an E25X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in SEQ ID NO: 1, or a corresponding mutation in another adenosine deaminase.

In some embodiments, the adenosine deaminase comprises an R26X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an, R26G, R26N, R26Q, R26C, R26L, or R26K mutation in SEQ ID NO: 1, or a corresponding mutation in another adenosine deaminase.

In some embodiments, the adenosine deaminase comprises an R107X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation in SEQ ID NO: 1, or a corresponding mutation in another adenosine deaminase.

In some embodiments, the adenosine deaminase comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in SEQ ID NO: 1, or a corresponding mutation in another adenosine deaminase.

In some embodiments, the adenosine deaminase comprises an A143X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in SEQ ID NO: 1, or a corresponding mutation in another adenosine deaminase.

In some embodiments, the adenosine deaminase comprises one or more of a H36X, N37X, P48X, I49X, R51X, M70X, N72X, D77X, E134X, S 146X, Q154X, K157X, and/or K161X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S 146R, S 146C, Q154H, K157N, and/or K161T mutation in SEQ ID NO: 1, or one or more corresponding mutations in another adenosine deaminase.

In some embodiments, the adenosine deaminase comprises an H36X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H36L mutation in SEQ ID NO: 1, or a corresponding mutation in another adenosine deaminase. In some embodiments, the adenosine deaminase comprises an N37X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an N37T, or N37S mutation in SEQ ID NO: 1, or a corresponding mutation in another adenosine deaminase.

In some embodiments, the adenosine deaminase comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an P48T, or P48L mutation in SEQ ID NO: 1, or a corresponding mutation in another adenosine deaminase.

In some embodiments, the adenosine deaminase comprises an R51X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R51H, or R51L mutation in SEQ ID NO: 1, or a corresponding mutation in another adenosine deaminase.

In some embodiments, the adenosine deaminase comprises an S 146X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an S 146R, or S 146C mutation in SEQ ID NO: 1, or a corresponding mutation in another adenosine deaminase.

In some embodiments, the adenosine deaminase comprises an K157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a K157N mutation in SEQ ID NO: 1, or a corresponding mutation in another adenosine deaminase.

In some embodiments, the adenosine deaminase comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in SEQ ID NO: 1, or a corresponding mutation in another adenosine deaminase.

In some embodiments, the adenosine deaminase comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a A142N mutation in SEQ ID NO: 1, or a corresponding mutation in another adenosine deaminase.

In some embodiments, the adenosine deaminase comprises an W23X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a W23R, or W23L mutation in SEQ ID NO: 1, or a corresponding mutation in another adenosine deaminase.

In some embodiments, the adenosine deaminase comprises an R152X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a R152P, or R52H mutation in SEQ ID NO: 1, or a corresponding mutation in another adenosine deaminase.

Additional adenosine deaminase mutations and variants are described in Patent Application WO2018119354, which is incorporated herein by reference in its entirety.

Additional adenosine deaminases useful in the present application would be apparent to the skilled artisan and are within the scope of this disclosure. For example, the adenosine deaminase may be a homolog of an AD AT. Exemplary AD AT homologs include, without limitation:

*Staphylococcus aureus* TadA:

(SEQ ID NO: 30)
MGSHMTNDIYFMTLAIEEAKKAAQLGEVPIGAIITKDDEVIARAHNLRE

TLQQPTAHAEHIAIERAAKVLGSWRLEGCTLYVTLEPCVMCAGTIVMSR

IPRVVYGADDPKGGCSGS LMNLLQQS NENHRAIVDKG VLKE AC S

TLLTTFFKNLRANKKS TN

*Bacillus subtilis* TadA:

(SEQ ID NO: 31)
MTQDELYMKEAIKEAKKAEEKGEVPIGAVL VINGEIIARAHNLRETEQ

RSIAHAEMLVIDE AC KALGT WRLEG ATLY VTLEPCPMC AG A

V VLS R VEK V VFGAFDPKGGC S GTLMN LLQEERFNHQ AE V

VS G VLEEEC GGMLS AFFRELRKKKKA ARKNLS E

*Salmonella typhimurium* (*S. typhimurium*) TadA:

(SEQ ID NO: 32)
MPPAFITGVTSLSDVELDHEYWMRHALTLAKRAWDEREVPVGAVLVHNH

R VIGEGWNRPIGRHDPTAHAEIMALRQGGLVLQNYRLLDTTLYVTLEP

CVMCAGAMVHSRIGRVVFGARDAKTGAAGSLIDVLHHPGMNHR VEIIE

GVLRDECATLLSDFFRMRRQEIKALKKADRAEGAGPAV

*Shewanella putrefaciens* (*S. putrefaciens*) TadA:

(SEQ ID NO: 33)
MDEYWMQVAMQMAEKAEAAGEVPVGAVLVKDGQQIATGYNLSISQHDPT

AHAEILCLRSAGKKLENYRLLDATLYITLEPCAMCAGAMVHSRIARVVY

GARDEKTGAAGTVVNLLQHPAFNHQVEVTSGVLAEACSAQLSRFFKRRR

DEKKALKLAQRAQQGIE

*Haemophilus influenzae* F3031 (*H. influenzae*) TadA:

(SEQ ID NO: 34)
MDAAKVRSEFDEKMMRYALELADKAEALGEIPVGAVL VDDARNIIGEG

WNLSIVQSDPTAHAEIIALRNGAKNIQNYRLLNSTLYVTLEPCTMCAGA

ILHSRIKRLVFGASDYKTGAIGSRFHFFDDYKMNHTLEITSGVLAEECS

QKLSTFFQKRREEKKIEKALLKSLSDK

*Caulobacter crescentus* (*C. crescentus*) TadA:

(SEQ ID NO: 35)
MRTDESEDQDHRMMRLALDAARAAAEAGETPVGAVILDPSTGEVIATAG

NGPIAAHDPTAHAEIAAMRAAAAKLGNYRLTDLTLVVTLEPCAMCAGAI

SHARIGRVVFGADDPKGGAVVHGPKFFAQPTCHWRPEVTGGVLADESAD

LLRGFFRARRKAKI

*Geobacter sulfurreducens* (*G. sulfurreducens*) TadA:

(SEQ ID NO: 36)
MSSLKKTPIRDDAYWMGKAIREAAKAAARDEVPIGAVIVRDGAVIGRGH

NLREGSNDPSAHAEMIAIRQAARRSANWRLTGATLYVTLEPCLMCMGAI

ILARLERVVFGCYDPKGGAAGSLYDLSADPRLNHQVRLSPGVCQEECGT

MLSDFFRDLRRRKKAKATPALFIDERKVPPEP

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the amino acid sequences listed in Table 23. In some embodiments, the adenosine deaminase comprises any one of the amino acid sequences listed in Table 23. In some embodiments, the sequence of the adenosine deaminase is any one of the amino acid sequences listed in Table 23. In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the amino acid sequences of SEQ ID NOs: SEQ ID NOs: 2137, 2149, 2154, 2158, 2188, 2140, 40, 2146, 2152, 2156, and 2160. In some embodiments, the adenosine deaminase comprises any one of the amino acid sequences of SEQ ID NOs: 2137, 2149, 2154, 2158, 2188, 2140, 40, 2146, 2152, 2156, and 2160. In some embodiments, the sequence of the adenosine deaminase is any one of the amino acid sequences of SEQ ID NOs: 2137, 2149, 2154, 2158, and 2188.

In some embodiments, the adenosine deaminase is encoded by the polynucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences listed in Table 23. In some embodiments, the adenosine deaminase is encoded by any one of the polynucleotide sequences listed in Table 23. In some embodiments, the adenosine deaminase is expressed by the polynucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences listed in Table 23. In some embodiments, the adenosine deaminase is expressed by any one of the polynucleotide sequences listed in Table 23. In some embodiments, the adenosine deaminase is encoded by the polynucleotide sequence that comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, and 2190. In some embodiments, the adenosine deaminase is encoded by the polynucleotide sequence that comprises any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, and 2190. In some embodiments, the adenosine deaminase is encoded by any one of the polynucleotide sequences of SEQ ID NOs: 2192, 2148, 2153, 2157, 2161, 2168, 2174, 2180, 2186, and 2189. In some embodiments, the adenosine deaminase is expressed by the polynucleotide sequence that comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, 2190, 2138, 2147, 2158, or a combination thereof. In some embodiments, the adenosine deaminase is encoded by the polynucleotide sequence that comprises any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, 2190, 2138, 2147, 2158, or a combination thereof. In some embodiments, the adenosine deaminase is expressed by any one of the polynucleotide sequences of SEQ ID NOs: 2192, 2148, 2153, 2157, 2161, 2168, 2174, 2180, 2186, and 2189. In some embodiments, the polynucleotide sequence further comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2138, 2147, 2158, or a combination thereof. In some embodiments, the polynucleotide sequence further comprises any one of the polynucleotide sequences of SEQ ID NOs: 2138, 2147, 2158, or a combination thereof.

Programmable DNA Binding Proteins

Provided herein are programmable DNA-binding proteins that can be programmed to target to bind DNA sequences in any desired nucleotide sequence within a genome. To program the DNA-binding protein to bind a desired nucleotide sequence, the DNA binding protein may be modified to change its binding specificity, e.g., zinc finger DNA-binding domain, zinc finger nuclease (ZFN), a CRISPR-Cas9 protein, or a transcription activator-like effector proteins (TALE). ZFNs are artificial restriction enzymes generated by fusing a zinc finger DNA-binding domain to a DNA-cleavage domain. Zinc finger domains can be engineered to target specific desired DNA sequences and this enables zinc-fingers to bind unique sequences within complex genomes. Transcription activator-like effector nucleases (TALEN) are engineered restriction enzymes that can be engineered to cut specific sequences of DNA. They are made by fusing a TAL effector DNA-binding domain to a nuclease domain (e.g. Fokl). Transcription activator-like effectors (TALEs) can be engineered to bind practically any desired DNA sequence. Methods for programming ZFNs and TALEs are familiar to one skilled in the art. For example, such methods are described in Maeder, et al, Mol. Cell 31 (2): 294-301, 2008; Carroll et al, Genetics Society of America, 188 (4): 773-782, 2011; Miller et al., Nature Biotechnology 25 (7): 778-785, 2007; Christian et al, Genetics 186 (2): 757-61, 2008; Li et al, Nucleic Acids Res. 39 (1): 359-372, 2010; and Moscou et al, Science 326 (5959): 1501, 2009, each of which are incorporated herein by reference.

A CRISPR/Cas system or a Cas protein in a base editor system provided herein may comprise Class 1 or Class 2 system components, including ribonucleic acid protein complexes. The Class 2 Cas nuclease families of proteins are enzymes with DNA endonuclease activity, and they can be directed to cleave a desired nucleic acid target by designing an appropriate guide RNA, as described further herein. A Class 2 CRISPR/Cas system component may be from a Type II, Type IIA, Type IIB, Type IIC, Type V, or Type VI system. Class 2 Cas nucleases include, for example, Cas9 (also known as Csn1 or Csx12), Csn2, Cas4, Cas12a (Cpf1), Cas12b (C2c1), Cas12c (C2c3), Cas13a (C2c2), Cas13b, Cas13c, and Cas13d proteins. In some embodiments, the Cas protein is from a Type II CRISPR/Cas system, i.e., a Cas9 protein from a CRISPR/Cas9 system, or a Type V CRISPR/Cas system, e.g., a Cas12a protein. In some embodiments, the Cas protein is from a Class 2 CRISPR/Cas system, i.e., a single-protein Cas nuclease such as a Cas9 protein or a Cas12a protein.

Other non-limiting examples of Cas proteins can include Cas1, Cas1B, Cas2, Cas3, Cas4, Cas5, Cas6, Cas7, Cas8, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, CsxlS, Csf1, Csf2, CsO, Csf4, Cpf1, Cas9HiFi, homologues thereof, or modified versions thereof.

In some embodiments, provided herein are guide nucleotide sequence-programmable DNA-binding protein or RNA guided programable DNA binding proteins that are able to bind DNA, and the binding to its target DNA sequence is mediated by a guide nucleotide sequence. Thus, it is appreciated that the guide nucleotide sequence-programmable DNA-binding protein binds to a guide nucleotide sequence. The guide nucleotide may be an RNA or DNA molecule (e.g., a single-stranded DNA or ssDNA molecule) that is complementary to the target sequence and can guide the DNA binding protein to the target sequence. As such, a guide nucleotide sequence-programmable DNA-binding protein may be a RNA-programmable DNA-binding protein (e.g., a Cas9 protein), or an ssDNA-programmable DNA-binding protein (e.g., an Argonaute protein). "Programmable" means the DNA-binding protein may be programmed to bind any DNA sequence that the guide nucleotide targets. Exemplary guide nucleotide sequence-programmable DNA-binding proteins include, but are not limited to, Cas9 (e.g., dCas9 and nCas9), saCas9 (e.g., saCas9d, saCas9d, saKKH Cas9) CasX, CasY, Cpf1, C2c1, C2c2, C2c3, Argonaute, and any other suitable protein described herein, or variants thereof.

In some embodiments, the guide nucleotide sequence exists as a single nucleotide molecule and comprises two domains: (1) a domain that shares homology to a target nucleic acid (e.g., and directs binding of a guide nucleotide sequence-programmable DNA-binding protein to the target); and (2) a domain that binds a guide nucleotide sequence-programmable DNA-binding protein. In some embodiments, domain (1) comprises a spacer sequence. In some embodiments, domain (2) is referred to as a tracrRNA sequence. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821(2012), which is incorporated herein by reference. Other examples of gRNAs (e.g., those including domain 2) can be found in U.S. Patent Application Publication US20160208288 and U.S. Patent Application Publication US20160200779 each of which is herein incorporated by reference in their entirety.

Methods of using guide nucleotide sequence-programmable DNA-binding protein, such as Cas9, for site-specific cleavage (e.g., to modify a genome) are known in the art (see e.g., Cong, L. et al. Multiplex genome engineering using CRISPR/Cas systems. Science 339, 819-823 (2013); *Mali*, P. et al. RNA-guided human genome engineering via Cas9. Science 339, 823-826 (2013); Hwang, W. Y. et al. Efficient genome editing in zebrafish using a CRISPR-Cas system.

Nature biotechnology 31, 227-229 (2013); Jinek, M. et al. RNA-programmed genome editing in human cells. eLife 2, e00471 (2013); Dicarlo, J. E. et al. Genome engineering in *Saccharomyces cerevisiae* using CRISPR-Cas systems. Nucleic acids research (2013); Jiang, W. et al. RNA-guided editing of bacterial genomes using CRISPR-Cas systems. Nature biotechnology 31, 233-239 (2013); each of which are incorporated herein by reference).

CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. A CRISPR/Cas system comprises a non-coding RNA molecule (e.g., guide RNA) that binds to DNA (e.g., target DNA sequence) and Cas proteins (e.g., Cas9) with nuclease functionality (e.g., two nuclease domains). See, e.g., Sander, et al., Nature Biotechnology, 32:347-355 (2014); see also e.g., Hsu, et al., Cell 157(6):1262-1278 (2014). The general mechanism and recent advances of CRISPR system is discussed in Cong, et al., Science, 339(6121): 819-823 (2013); Fu, et al., Nature Biotechnology, 31, 822-826 (2013); Chu, et al., Nature Biotechnology 33, 543-548 (2015); Shmakov, et al., Molecular Cell, 60, 1-13 (2015); Makarova, et al., Nature Reviews Microbiology, 13, 1-15 (2015). CRISPR/Cas systems can be used to introduce site-specific cleavage of a target DNA. The locations for site-specific cleavage are determined by both 1) base-pairing complementarity between the guide RNA (gRNA) and the target DNA (a protospacer) and 2) a short motif in the target DNA referred to as the protospacer adjacent motif (PAM). CRISPR/Cas systems (e.g., Type II CRISPR/Cas system) can be used to generate, e.g., an engineered cell in which a target gene is disrupted or mutated. A Cas enzyme (e.g., Cas9) can be used to catalyze DNA cleavage. A Cas9 protein (e.g., a *Streptococcus pyogenes* Cas9 or any closely related Cas9) can derive an enzymatic action to generate double stranded breaks at target site sequences which hybridize to about 20 nucleotides of a guide sequence (e.g., gRNA) and that have a protospacer-adjacent motif (PAM) following the target sequence.

CRISPR/Cas system comprises Class 1 or Class 2 system components, including ribonucleic acid protein complexes. The Class 2 Cas nuclease families of proteins are enzymes with DNA endonuclease activity, and they can be directed to cleave a desired nucleic acid target by designing an appropriate guide RNA, as described further herein. A Class 2 CRISPR/Cas system component may be from a Type II, Type IIA, Type IIB, Type IIC, Type V, or Type VI system. Class 2 Cas nucleases include, for example, Cas9 (also known as Csn1 or Csx12), Csn2, Cas4, Cas12a (Cpf1), Cas12b (C2c1), Cas12c (C2c3), Cas13a (C2c2), Cas13b, Cas13c, and Cas13d proteins. In some embodiments, the Cas protein is from a Type II CRISPR/Cas system, i.e., a Cas9 protein from a CRISPR/Cas9 system, or a Type V CRISPR/Cas system, e.g., a Cas12a protein. In some embodiments, the Cas protein is from a Class 2 CRISPR/Cas system, i.e., a single-protein Cas nuclease such as a Cas9 protein or a Cas12a protein.

Other non-limiting examples of Cas proteins can include Cas1, Cas1B, Cas2, Cas3, Cas4, Cas5, Cas6, Cas7, Cas8, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, Cas9HiFi, homologues thereof, or modified versions thereof.

A base editor system provided herein may comprise a Cas9 or a Cas9 nuclease. A Cas9 protein or a Cas9 nuclease refers to an RNA-guided nuclease comprising a Cas9 protein, a fragment, or a variant thereof. A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek et al., Science 337:816-821(2012), which is incorporated herein by reference in its entirety.

The term "Cas9" refers to an RNA guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to as a Casn1 nuclease or a CRISPR (clustered regularly interspaced short palindromic repeat) associated nuclease. Cas9 can refer to a polypeptide with at least or at least about 50%, 60%, 70%, 80%, 90%, 100% sequence identity and/or sequence similarity to a wild type exemplary Cas9 polypeptide (e.g., Cas9 from *S. pyogenes*). Cas9 can refer to a polypeptide with at most or at most about 50%, 60%, 70%, 80%, 90%, 100% sequence identity and/or sequence similarity to a wild type exemplary Cas9 polypeptide (e.g., from *S. pyogenes*). Cas9 can refer to the wild type or a modified form of the Cas9 protein that can comprise an amino acid change such as a deletion, insertion, substitution, variant, mutation, fusion, chimera, or any combination thereof.

Cas9 nuclease sequences and structures of variant Cas9 orthologs have been described in various species. Exemplary species that the Cas9 protein or other components can be from include, but are not limited to, *Streptococcus pyogenes, Streptococcus thermophilus, Streptococcus* sp., *Staphylococcus aureus, Listeria innocua, Lactobacillus gasseri, Francisella novicida, Wolinella succinogenes, Sutterella wadsworthensis, Gamma* proteobacterium, *Neisseria meningitidis, Campylobacter jejuni, Pasteurella multocida, Fibrobacter succinogene, Rhodospirillum rubrum, Nocardiopsis dassonvillei, Streptomyces pristinaespiralis, Streptomyces viridochromogenes, Streptomyces viridochromogenes, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Lactobacillus buchneri, Treponema denticola, Microscilla marina,* Burkholderiales *bacterium,* Polar omonas *naphthalenivorans,* Polar omonas sp., Crocosphaera *watsonii,* Cyanothece sp., Microcystis *aeruginosa,* Synechococcus sp., *Acetohalobium arabaticum, Ammonifex degensii,* Caldicelulosiruptor becscii, Candidatus Desulforudis, *Clostridium botulinum*, *Clostridium difficile*, *Finegoldia magna*, *Natranaerobius thermophilus*, *Pelotomaculum* thermopropionium, *Acidithiobacillus caldus*, *Acidithiobacillus ferrooxidans*, *Allochromatium vinosum*, *Marinobacter* sp., *Nitrosococcus halophilus*, *Nitrosococcus watsoni*, *Pseudoalteromonas haloplanktis*, *Ktedonobacter racemifer*, *Methanohalobium evestigatum*, *Anabaena variabilis*, *Nodularia spumigena*, *Nostoc* sp., *Arthrospira maxima*, *Arthrospira platensis*, *Arthrospira* sp., *Lyngbya* sp., *Microcoleus chthonoplastes*, Oscillator ia sp., *Petrotoga mobilis*, *Thermosipho africanus*, *Streptococcus pasteurianus*, *Neisseria cinerea*, *Campylobacter lari*, Parvibaculum lavamentivorans, Coryne *bacterium* diphtheria, or Acaryochloris *marina*. In some embodiments, the Cas9 protein is from *Streptococcus pyogenes*. In some embodiments, the Cas9 protein may be from *Streptococcus thermophilus*. In some embodiments, the Cas9 protein is from *Staphylococcus aureus*.

Additional suitable Cas9 nucleases and sequences will be apparent to those of skill in the art based on this disclosure, and such Cas9 nucleases and sequences include Cas9 sequences from the organisms and loci disclosed in Chylinski et al., (2013) RNA Biology 10:5, 726-737; which are incorporated herein by reference.

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows)

```
(SEQ ID NO: 37)
ATGGATAAGAAATACTCAATAGGCTTAGATATCGGCACAAATAGCGTCG

GATGGGCGGTGATCACTGATGAATATAAGGTTCCGTCTAAAAAGTTCAA

GGTTCTGGGAAATACAGACCGCCACAGTATCAAAAAAATCTTATAGGG

GCTCTTTTATTTGACAGTGGAGAGACAGCGGAAGCGACTCGTCTCAAAC

GGACAGCTCGTAGAAGGTATACACGTCGGAAGAATCGTATTTGTTATCT

ACAGGAGATTTTTTCAAATGAGATGGCGAAAGTAGATGATAGTTTCTTT

CATCGACTTGAAGAGTCTTTTTTGGTGGAAGAAGACAAGAAGCATGAAC

GTCATCCTATTTTTGGAAATATAGTAGATGAAGTTGCTTATCATGAGAA

ATATCCAACTATCTATCATCTGCGAAAAAAATTGGTAGATTCTACTGAT

AAAGCGGATTTGCGCTTAATCTATTTGGCCTTAGCGCATATGATTAAGT

TTCGTGGTCATTTTTTGATTGAGGGAGATTTAAATCCTGATAATAGTGA

TGTGGACAAACTATTTATCCAGTTGGTACAAACCTACAATCAATTATTT

GAAGAAAACCCTATTAACGCAAGTGGAGTAGATGCTAAAGCGATTCTTT

CTGCACGATTGAGTAAATCAAGACGATTAGAAAATCTCATTGCTCAGCT

CCCCGGTGAGAAGAAAATGGCTTATTTGGGAATCTCATTGCTTTGTCA

TTGGGTTTGACCCCTAATTTTAAATCAAATTTTGATTTGGCAGAAGATG

CTAAATTACAGCTTTCAAAAGATACTTACGATGATGATTTAGATAATTT

ATTGGCGCAAATTGGAGATCAATATGCTGATTTGTTTTTGGCAGCTAAG

AATTTATCAGATGCTATTTTACTTTCAGATATCCTAAGAGTAAATACTG

AAATAACTAAGGCTCCCCTATCAGCTTCAATGATTAAACGCTACGATGA

ACATCATCAAGACTTGACTCTTTTAAAAGCTTTAGTTCGACAACAACTT

CCAGAAAAGTATAAAGAAATCTTTTTTGATCAATCAAAAAACGGATATG

CAGGTTATATTGATGGGGGAGCTAGCCAAGAAGAATTTTATAAATTTAT

CAAACCAATTTTAGAAAAAATGGATGGTACTGAGGAATTATTGGTGAAA

CTAAATCGTGAAGATTTGCTGCGCAAGCAACGGACCTTTGACAACGGCT

CTATTCCCCATCAAATTCACTTGGGTGAGCTGCATGCTATTTTGAGAAG

ACAAGAAGACTTTTATCCATTTTTAAAAGACAATCGTGAGAAGATTGAA

AAAATCTTGACTTTTCGAATTCCTTATTATGTTGGTCCATTGGCGCGTG

GCAATAGTCGTTTTGCATGGATGACTCGGAAGTCTGAAGAAACAATTAC

CCCATGGAATTTTGAAGAAGTTGTCGATAAAGGTGCTTCAGCTCAATCA

TTTATTGAACGCATGACAAACTTTGATAAAAATCTTCCAAATGAAAAAG

TACTACCAAAACATAGTTTGCTTTATGAGTATTTTACGGTTTATAACGA

ATTGACAAAGGTCAAATATGTTACTGAAGGAATGCGAAAACCAGCATTT

CTTTCAGGTGAACAGAAGAAAGCCATTGTTGATTTACTCTTCAAAACAA

ATCGAAAAGTAACCGTTAAGCAATTAAAAGAAGATTATTTCAAAAAAAT

AGAATGTTTTGATAGTGTTGAAATTTCAGGAGTTGAAGATAGATTTAAT

GCTTCATTAGGTACCTACCATGATTTGCTAAAAATTATTAAAGATAAAG

ATTTTTTGGATAATGAAGAAAATGAAGATATCTTAGAGGATATTGTTTT

AACATTGACCTTATTTGAAGATAGGGAGATGATTGAGGAAAGACTTAAA

ACATATGCTCACCTCTTTGATGATAAGGTGATGAAACAGCTTAAACGTC

GCCGTTATACTGGTTGGGGACGTTTGTCTCGAAAATTGATTAATGGTAT

TAGGGATAAGCAATCTGGCAAAACAATATTAGATTTTTTGAAATCAGAT

GGTTTTGCCAATCGCAATTTTATGCAGCTGATCCATGATGATAGTTTGA

CATTTAAAGAAGACATTCAAAAAGCACAAGTGTCTGGACAAGGCGATAG

TTTACATGAACATATTGCAAATTTAGCTGGTAGCCCTGCTATTAAAAAA

GGTATTTTACAGACTGTAAAAGTTGTTGATGAATTGGTCAAAGTAATGG

GGCGGCATAAGCCAGAAAATATCGTTATTGAAATGGCACGTGAAAATCA

GACAACTCAAAAGGGCCAGAAAAATTCGCGAGAGCGTATGAAACGAATC

GAAGAAGGTATCAAAGAATTAGGAAGTCAGATTCTTAAAGAGCATCCTG

TTGAAAATACTCAATTGCAAAATGAAAAGCTCTATCTCTATTATCTCCA

AAATGGAAGAGACATGTATGTGGACCAAGAATTAGATATTAATCGTTTA

AGTGATTATGATGTCGATCACATTGTTCCACAAAGTTTCCTTAAAGACG

ATTCAATAGACAATAAGGTCTTAACGCGTTCTGATAAAAATCGTGGTAA

ATCGGATAACGTTCCAAGTGAAGAAGTAGTCAAAAAGATGAAAAACTAT

TGGAGACAACTTCTAAACGCCAAGTTAATCACTCAACGTAAGTTTGATA

ATTTAACGAAAGCTGAACGTGGAGGTTTGAGTGAACTTGATAAAGCTGG

TTTTATCAAACGCCAATTGGTTGAAACTCGCCAAATCACTAAGCATGTG

GCACAAATTTTGGATAGTCGCATGAATACTAAATACGATGAAAATGATA

AACTTATTCGAGAGGTTAAAGTGATTACCTTAAAAATCTAAATTAGTTTC

TGACTTCCGAAAAGATTTCCAATTCTATAAAGTACGTGAGATTAACAAT

TACCATCATGCCCATGATGCGTATCTAAATGCCGTCGTTGGAACTGCTT

TGATTAAGAAATATCCAAAACTTGAATCGGAGTTTGTCTATGGTGATTA
```

```
TAAAGTTTATGATGTTCGTAAAATGATTGCTAAGTCTGAGCAAGAAATA

GGCAAAGCAACCGCAAAATATTTCTTTTACTCTAATATCATGAACTTCT

TCAAAACAGAAATTACACTTGCAAATGGAGAGATTCGCAAACGCCCTCT

AATCGAAACTAATGGGGAAACTGGAGAAATTGTCTGGGATAAAGGGCGA

GATTTTGCCACAGTGCGCAAAGTATTGTCCATGCCCCAAGTCAATATTG

TCAAGAAAACAGAAGTACAGACAGGCGGATTCTCCAAGGAGTCAATTTT

ACCAAAAAGAAATTCGGACAAGCTTATTGCTCGTAAAAAAGACTGGGAT

CCAAAAAAATATGGTGGTTTTGATAGTCCAACGGTAGCTTATTCAGTCC

TAGTGGTTGCTAAGGTGGAAAAAGGGAAATCGAAGAAGTTAAAATCCGT

TAAAGAGTTACTAGGGATCACAATTATGGAAAGAAGTTCCTTTGAAAAA

AATCCGATTGACTTTTTAGAAGCTAAAGGATATAAGGAAGTTAAAAAAG

ACTTAATCATTAAACTACCTAAATATAGTCTTTTTGAGTTAGAAAACGG

TCGTAAACGGATGCTGGCTAGTGCCGGAGAATTACAAAAAGGAAATGAG

CTGGCTCTGCCAAGCAAATATGTGAATTTTTTATATTTAGCTAGTCATT

ATGAAAAGTTGAAGGGTAGTCCAGAAGATAACGAACAAAAACAATTGTT

TGTGGAGCAGCATAAGCATTATTTAGATGAGATTATTGAGCAAATCAGT

GAATTTTCTAAGCGTGTTATTTTAGCAGATGCCAATTTAGATAAAGTTC

TTAGTGCATATAACAAACATAGAGACAAACCAATACGTGAACAAGCAGA

AAATATTATTCATTTATTTACGTTGACGAATCTTGGAGCTCCCGCTGCT

TTTAAATATTTTGATACAACAATTGATCGTAAACGATATACGTCTACAA

AAGAAGTTTTAGATGCCACTCTTATCCATCAATCCATCACTGGTCTTTA

TGAAACACGCATTGATTTGAGTCAGCTAGGAGGTGACTGA
```

(SEQ ID NO: 38)
```
MDKKYSIGLDIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD
```

In some embodiments, Cas9 is a Cas9 protein from species *Corynebacterium ulcerans* (NCBI Refs: NC_015683.1, NC_017317.1); *Corynebacterium diphtheria* (NCBI Refs. NC 016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Listeria innocua* (NCBI Ref: NP_472073.1), *Campylobacter jejuni* (NCBI Ref: YP_002344900.1) or *Neisseria, meningitidis* (NCBI Ref: YP_002342100.1).

In some embodiments, a base editor provided herein comprises a programmable DNA binding protein, e.g. a Cas nuclease, with reduced or abolished nuclease activity. For example a Ca9 protein may be nuclease inactive or may be a Cas9 nickase. Methods for generating a Cas9 protein (or a fragment thereof) having an inactive DNA cleavage domain are known (See, e.g., Jinek et al., Science. 337:816-821(2012); Qi et al, (2013) Cell. 28; 152(5): 1173-83, each of which are incorporated herein by reference in its entirety. For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., Science. 337:816-821(2012); Qi et al, Cell. 28; 152(5): 1173-83 (2013)). The Cas9 nickase suitable for use in accordance with the present disclosure has an active HNH domain and an inactive RuvC domain and is able to cleave only the strand of the target DNA that is bound by the sgRNA (which is the opposite strand of the strand that is being edited via cytidine deamination). The Cas9 nickase of the present disclosure may comprise mutations that inactivate the RuvC domain, e.g., a D1OA mutation. It is to be understood that any mutation that inactivates the RuvC domain may be included in a Cas9 nickase, e.g., insertion, deletion, or single or multiple amino acid substitution in the RuvC domain. In a Cas9 nickase described herein, while the RuvC domain is inactivated, the HNH domain remains activate. Thus, while the Cas9 nickase may comprise mutations other than those that inactivate the RuvC domain (e.g., D10A), those mutations do not affect the activity of the HNH domain. In a non-limiting Cas9 nickase example, the histidine at position 840 remains unchanged.

In some embodiments, a nuclease inactive Cas9 comprises the amino acid sequence of dCas9 (D10A and H840A) provided below:

(SEQ ID NO: 39)
```
MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD
```

In some embodiments, a Cas9 nickase comprises the amino acid sequence of an exemplary catalytically Cas9 nickase (nCas9) is as follows:

(SEQ ID NO: 40)
```
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD
```

Additional suitable mutations that inactivate Cas9 will be apparent to those of skill in the art based on this disclosure and knowledge in the field, and are within the scope of this disclosure. Such additional exemplary suitable nuclease-inactive Cas9 domains include, but are not limited to, D839A and/or N863A (See, e.g., Prashant et al, Nature Biotechnology. 2013; 31(9): 833-838, which are incorporated herein by reference), or), or K603R {See, e.g., Chavez et al., Nature Methods 12, 326-328, 2015, which is incorporated herein by reference). Cas9, dCas9, or Cas9 variant also encompasses Cas9, dCas9, or Cas9 variants from any organism. Also appreciated is that dCas9, Cas9 nickase, or other appropriate Cas9 variants from any organisms may be used in accordance with the present disclosure.

In some embodiments, Cas9 refers to a Cas9 from archaea (e.g. nanoarchaea), which constitute a domain and kingdom of single-celled prokaryotic microbes.

In some embodiments, the programmable DNA binding protein comprises a CasX or CasY, or a variant thereof, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered.

Some aspects of the disclosure provide high fidelity Cas9 domains of the nucleobase editors provided herein. In some embodiments, high fidelity Cas9 domains are engineered Cas9 domains comprising one or more mutations that decrease electrostatic interactions between the Cas9 domain and the sugar-phosphate backbone of DNA, as compared to a corresponding wild-type Cas9 domain. Without wishing to be bound by any particular theory, high fidelity Cas9 domains that have decreased electrostatic interactions with the sugar-phosphate backbone of DNA may have less off-target effects. In some embodiments, the Cas9 domain comprises one or more mutations that decreases the association between the Cas9 domain and the sugar-phosphate backbone of DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, or more. In some embodiments, any of the Cas9 fusion proteins provided herein comprise one or more of N497X, R661X, Q695X, and/or Q926X mutation as numbered in the wild type Cas9 amino acid sequence or a corresponding amino acid in another Cas9, wherein X is any amino acid. In some embodiments, any of the Cas9 or Cas9 fusion proteins provided herein comprise one or more of N497A, R661A, Q695A, and/or Q926A mutation of the amino acid sequence provided in the wild type Cas9 sequence, or a corresponding mutation as numbered in the wild type Cas9 amino acid sequence or a corresponding amino acid in another Cas9. Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

It should be appreciated that any of the base editors provided herein, for example, any of the adenosine deaminase base editors provided herein, may be converted into high fidelity base editors by modifying the Cas9 domain as described herein to generate high fidelity base editors, for example, a high fidelity adenosine base editor. In some embodiments, the high fidelity Cas9 domain is a nuclease inactive Cas9 domain. In some embodiments, the high fidelity Cas9 domain is a Cas9 nickase domain.

In some embodiments, a Cas protein comprises a CasX or CasY, or a variant thereof, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered.

Alternatives to *S. pyogenes* Cas9 may include RNA-guided endonucleases from the Cpf1 family that exhibit cleavage activity in mammalian cells. Cpf1-mediated DNA cleavage is a double-strand break with a short 3' overhang, which is different from Cas9-mediated DNA cleavage. The staggered cleavage pattern of Cpf1 may open up the possibility of directional gene transfer, analogous to traditional restriction enzyme cloning, which may increase the efficiency of gene editing. Like the Cas9 variants and orthologues described above, Cpf1 may also expand the number of sites that can be targeted by CRISPR to AT-rich regions or AT-rich genomes that lack the NGG PAM sites favored by SpCas9.

In some embodiments, the Cas9 protein comprises an amino acid sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the amino acid sequences listed in Table 23. In some embodiments, the Cas9 protein comprises any one of the amino acid sequences listed in Table 23. In some embodiments, the sequence of the Cas9 protein is any one of the amino acid sequences listed in Table 23. In some embodiments, the Cas9 protein comprises an amino acid sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the amino acid sequences of SEQ ID NOs: 2137, 2149, 2154, 2158, 2188, 2140, 40, 2146, 2152, 2156, and 2160. In some embodiments, the Cas9 protein comprises any one of the amino acid sequences of SEQ ID NOs: 2137, 2149, 2154, 2158, 2188, 2140, 40, 2146, 2152, 2156, and 2160. In some embodiments, the sequence of the Cas9 protein is any one of the amino acid sequences of SEQ ID NOs: 2137, 2149, 2154, 2158, and 2188.

In some embodiments, the Cas9 protein is encoded by the polynucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences listed in Table 23. In some embodiments, the Cas9 protein is encoded by any one of the polynucleotide sequences listed in Table 23. In some embodiments, the Cas9 protein is expressed by the polynucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences listed in Table 23. In some embodiments, the Cas9 protein is expressed by any one of the polynucleotide sequences listed in Table 23. In some embodiments, the Cas9 protein is encoded by the polynucleotide sequence that is at In some embodiments, the Cas9 protein is encoded by the polynucleotide sequence that comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, and 2190. In some embodiments, the Cas9 protein is encoded by the polynucleotide sequence that comprises any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, and 2190. In some embodiments, the Cas9 protein is encoded by any one of the polynucleotide sequences of SEQ ID NOs: 2192, 2148, 2153, 2157, 2161, 2168, 2174, 2180, 2186, and 2189. In some embodiments, the Cas9 protein is expressed by the polynucleotide sequence that comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, 2190, 2138, 2147, 2158, or a combination thereof. In some embodiments, the Cas9 protein is encoded by the polynucleotide sequence that comprises any one of the polynucleotide sequences of SEQ ID NOs: 2192, 2148, 2153, 2157, 2161, 2168, 2174, 2180, 2186, 2189, 2139, 2142, 2145, 2151, 2155, 2159, 2162, 2164, 2167, 2169, 2171, 2173, 2175, 2177, 2179, 2181, 2183, 2185, 2187, 2190, 2138, 2147, 2158, or a combination thereof. In some embodiments, the Cas9 protein is expressed by any one of the polynucleotide sequences of SEQ ID NOs: 2192, 2148, 2153, 2157, 2161, 2168, 2174, 2180, 2186, and 2189. In some embodiments, the polynucleotide sequence further comprises at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the polynucleotide sequences of SEQ ID NOs: 2138, 2147, 2158, or a combination thereof. In some embodiments, the polynucleotide sequence further comprises any one of the polynucleotide sequences of SEQ ID NOs: 2138, 2147, 2158, or a combination thereof.

Linkers

Base editors provided herein may comprises linkers that connect one or more components of the base editors. In certain embodiments, linkers may be used to link any of the protein or protein domains described herein. The linker may be as simple as a covalent bond, or it may be a polymeric linker many atoms in length. In certain embodiments, the linker is a polypeptide or based on amino acids. In other embodiments, the linker is not peptide-like. In some embodiments, the linker is carbon bond, disulfide bond, carbon-heteroatom bond, etc. In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 17), which may also be referred to as the XTEN linker. In some embodiments, a linker comprises the amino acid sequence SGGS. In some embodiments, a linker comprises (SGGS)n (SEQ ID NO: 41), (GGGS)n (SEQ ID NO: 42), (GGGGS)n (SEQ ID NO: 43), (G)n (SEQ ID NO: 44), (EAAAK)n (SEQ ID NO: 45), (GGS)n (SEQ ID NO: 46), SGSETPGTSESATPES (SEQ ID NO: 17), or (XP)n (SEQ ID NO: 47) motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 17), SGGSSGSETPGTSESATPESSGGS (SEQ ID NO: 19). In some embodiments, a linker comprises
   SGGSSGGSSGSETPGTSESATPESSGGSSGGS (SEQ ID NO: 20). In some embodiments, a linker comprises
   GGSGGSPGSPAGSPTSTEEGTSESATPESGPGT-
    STEPSEGSAPGSPAGSPTSTEEGTSTE
    PSEGSAPGTSTEPSEGSAPGTSESAT-
    PESGPGSEPATSGGSGGS (SEQ ID NO: 21). In some embodiments, the linker is 24 amino acids in length. In some embodiments, the linker comprises the amino acid sequence SGGSSGGSSGSETPGTSESATPES (SEQ ID NO: 23).

In some embodiments, the linker is 40 amino acids in length. In some embodiments, the linker comprises the amino acid sequence
   SGGSSGGSSGSETPGTSESAT-
    PESSGGSSGGSSGGSSGGS (SEQ ID NO: 24). In some embodiments, the linker is 64 amino acids in length. In some embodiments, the linker comprises the amino acid sequence
   SGGSSGGSSGSETPGTSESAT-
    PESSGGSSGGSSGGSSGGSSGGSSGSETPGTSESAT-
    PESSGGS SGGS (SEQ ID NO: 25). In some embodiments, the linker is 92 amino acids in length. In some embodiments, the linker comprises the amino acid sequence
   PGSPAGSPTSTEEGTSESATPESGPGT-
    STEPSEGSAPGSPAGSPTSTEEGTSTEPSEGSAP
    GTSTEPSEGSAPGTSESATPESGPGSEPATS (SEQ ID NO: 26). It should be appreciated that any of the linkers provided herein may be used to link a first adenosine deaminase and a second adenosine deaminase; a deaminase (e.g., a first or a second adenosine deaminase) and a RNA guided programmable DNA binding protein; a RNA guided programmable DNA binding protein and an NLS; or a deaminase (e.g., a first or a second adenosine deaminase) and an NLS.

Various linker lengths and flexibilities between a deaminase (e.g., an engineered ecTadA) and a RNA guided programmable DNA binding protein (e.g., a Cas9 domain), and/or between a first adenosine deaminase and a second adenosine deaminase can be employed (e.g., ranging from very flexible linkers of the form (GGGGS)n (SEQ ID NO:

22), (GGGGS)n (SEQ ID NO: 22), and (G)n to more rigid linkers of the form (EAAAK)n (SEQ ID NO: 48), (SGGS)n (SEQ ID NO: 49), and (XP)n) in order to achieve the optimal length for deaminase activity for the specific application. In some embodiments, n is any integer between 3 and 30. In some embodiments, n is 1, 2, 3, 4, 5, 6, 7, 8, 9, 10, 11, 12, 13, 14, or 15. In some embodiments, the linker comprises a (GGS)n (SEQ ID NO: 51) motif, wherein n is 1, 3, or 7.

Protospacer Adjacent Motifs

CRISPR clusters contain spacers, sequences complementary to antecedent mobile elements, and target invading nucleic acids. CRISPR clusters are transcribed and processed into CRISPR RNA (crRNA). For example, in type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Cas9 recognizes a short motif in the CRISPR repeat sequences (the PAM or protospacer adjacent motif) (see, e.g., "Complete genome sequence of an M1 strain of *Streptococcus pyogenes*." Ferretti et ah, J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., Natl. Acad. Sci. U.S.A. 98:4658-4663(2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, *S. pyogenes* and *S. thermophilus*.

Some aspects of the disclosure provide programmed DNA binding protein domains, e.g. Cas9 domains that have altered PAM specificities. In some embodiments, a Cas9 derived from *S. pyogenes* (spCas9) recognizes a canonical NGG PAM sequence where the "N" in "NGG" is adenine (A), thymine (T), guanine (G), or cytosine (C), and the G is guanine. In some embodiments, the base editing fusion proteins provided herein function by deaminating a target nucleobase within a 4 base region (e.g., a "deamination window"), which is approximately 15 bases upstream of the PAM. In some embodiments, the deamination window is 5, 6, 7, 8, 9, 10, 11, 12, 13, 14, 15, 16, 17, 18, 19, 20, 21, 22, 23, 24, or 25 bases upstream of the PAM. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et ah, "Broadening the targeting range of *Staphylococcus aureus* CRISPR-Cas9 by modifying PAM recognition" Nature Biotechnology 33, 1293-1298 (2015); the entire contents of each are hereby incorporated by reference. In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). A wild type SaCas9 amino acid sequence is provided below:

(SEQ ID NO: 52)
KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEENSKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNRELIN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFYNNDLIKINGELYRV

IGVNNDLLNRIEVNMIDITYREYLENMNDKRPPRIIKTIASKTQSIKKY

STDILGNLYEVKSKKHPQIIKKG

In some embodiments, the SaCas9 comprises a N579X mutation, or a corresponding mutation in any of the amino acid sequences as numbered in the wild type SaCas9 sequence, wherein X is any amino acid except for N. In some embodiments, the SaCas9 comprises a N579A mutation as numbered in the wild type SaCas9 sequence or a corresponding mutation in another SaCas9 protein.

In some embodiments, the SaCas9 domain, the nuclease inactive SaCas9 domain, or the SaCas9 nickase domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence, where N=A, T, C, or G, and R=A or G. In some embodiments, the SaCas9 domain comprises one or more of E781X, N967X, and R1014X as numbered in the wild type SaCas9 sequence or a corresponding mutation in another SaCas9 protein wherein X is any amino acid. In some embodiments, the SaCas9 domain comprises one or more of a E781K, a N967K, and a R1014H mutation as numbered in the wild type SaCas9 sequence or a corresponding mutation in another SaCas9 protein. In some embodiments, the SaCas9 domain comprises a E781K, a N967K, or a R1014H mutation as numbered in the wild type SaCas9 sequence or a corresponding mutation in another SaCas9 protein.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D10X mutation as numbered in the wild type SpCas9 amino acid sequence or a corresponding mutation in another SapCas9 protein, wherein X is any amino acid except for D. In some embodiments, the SpCas9 comprises a D10A mutation as numbered in the wild type SpCas9 amino acid sequence or a corresponding mutation in another SpCas9 protein. In some embodiments, the SpCas9 domain, the nuclease in active SpCas9 domain, or the SpCas9 nickase domain can bind to a nucleic acid sequence having a non-NGG PAM. In some embodiments, the SpCas9 domain, the SpCas9 domain, the nuclease in active SpCas9 domain, or the SpCas9 nickase domain can bind to a nucleic acid sequence having a NGG, a NGA, or a NGCG PAM sequence. In some embodiments, the SpCas9 domain comprises one or more of a D1135X, a R1335X, and a T1337X mutation as numbered in the wild type SpCas9 amino acid sequence or a corresponding mutation in another SpCas9 protein, wherein X is any amino acid. In some embodiments, the SpCas9 domain comprises one or more of a D1135E, R1335Q, and T1337R mutation as numbered in the wild type SpCas9 amino acid sequence or a corresponding mutation in another SpCas9 protein. In some embodiments, the SpCas9 domain comprises one or more of a D1134V, a R1334Q, and a T1336R mutation as numbered in the wild type Cas9 amino acid sequence, or a corresponding mutation thereof. In some embodiments, the SpCas9 domain comprises a D1135V, a R1335Q, and a T1337R mutation as numbered in the wild type SpCas9 amino acid sequence or a corresponding mutation in another SpCas9 protein. In some embodiments, the SpCas9 domain comprises one or more of a D1135X, a G1218X, a R1335X, and a T1337X mutation as numbered in the wild type SpCas9 amino acid sequence or a corresponding mutation in another SpCas9 protein, wherein X is any amino acid. In some embodiments, the SpCas9 domain comprises one or more of a D1135V, a G1218R, a R1335Q, and a T1337R mutation as numbered in the wild type SpCas9 amino acid sequence or a corresponding mutation in another SpCas9 protein. In some embodiments, the SpCas9 domain comprises a D1135V, a G1218R, a R1335Q, and a T1337R mutation as numbered in the wild type SpCas9 amino acid sequence or a corresponding mutation in another SpCas9 protein.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 sequences provided herein.

In some embodiments, a base editor provided herein comprises a RNA guide programmable DNA binding protein that may be used to target and modify a specific nucleic acid (e.g., DNA or RNA) sequence. Nucleic acid programmable DNA binding proteins include, without limitation, Cas9 (e.g., nuclease inactive Cas9 and Cas9 nickase), CasX, CasY, Cas12a (Cpf1), Cas12b, C2c1, C2c2, C2C3, and Argonaute. One example of an nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Cpf1 proteins described in Yamano et ah, "Crystal structure of Cpf1 in complex with guide RNA and target DNA." Cell (165) 2016, p. 949-962; the entire contents of which is hereby incorporated by reference.

In some embodiments, a base editor provided herein comprises a nuclease inactive Cpf1 protein or a variant thereof. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. In some embodiments, the Cpf1 nickase comprises one or more mutations corresponding to D917A, E1006A, or D1255A as numbered in the *Francisella novicida* Cpf1 protein.

Wild type *Francisella novicida* Cpf1 amino acid sequence is provided below:

(SEQ ID NO: 53)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKFNTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVEDDYSVIGTAVLEYITQQIAPKNLDNPSKKEQELI

AKKTEKAKYLSLETIKLALEEFNKHRDIDKQCRFEEILANFAAIPMIFD

EIAQNKDNLAQISIKYQNQGKKDLLQASAEDDVKAIKDLLDQTNNLLHK

LKIPHISQSEDKANILDKDEHFYLVFEECYFELANIVPLYNKIRNYITQ

KPYSDEKFKLNFENSTLANGWDKNKEPDNTAILFIKDDKYYLGVMNKKN

NKIFDDKAIKENKGEGYKKIVYKLLPGANKMLPKVFFSAKSIKFYNPSE

DILRIRNHSTHTKNGSPQKGYEKFEFNIEDCRKFIDFYKQSISKHPEWK

DFGFRFSDTQRYNSIDEFYREVENQGYKLTFENISESYIDSVVNQGKLY

LFQIYNKDFSAYSKGRPNLHTLYWKALFDERNLQDVVYKLNGEAELFYR

KQSIPKKITHPAKEAIANKNKDNPKKESVFEYDLIKDKRFTEDKFFFHC

PITINFKSSGANKFNDEINLLLKEKANDVHILSIDRGERHLAYYTLVDG

KGNIIKQDTFNIIGNDRMKTNYHDKLAAIEKDRDSARKDWKKINNIKEM

KEGYLSQVVHEIAKLVIEYNAIVVFEDLNFGFKRGRFKVEKQVYQKLEK

MLIEKLNYLVFKDNEFDKTGGVLRAYQLTAPFETFKKMGKQTGIIYYVP

AGFTSKICPVTGFVNQLYPKYESVSKSQEFFSKFDKICYNLDKGYFEFS

FDYKNFGDKAAKGKWTIASFGSRLINFRNSDKNHNWDTREVYPTKELEK

LLKDYSIEYGHGECIKAAICGESDKKFFAKLTSVLNTILQMRNSKTGTE

LDYLISPVADVNGNFFDSRQAPKNMPQDADANGAYHIGLKGLMLLGRIK

NNQEGKKLNLVIKNEEYFEFVQNRNN

In some embodiments, the base editor comprises a Cpf1 protein. In some embodiments, the Cpf1 protein is a Cpf1 nickase. In some embodiments, the Cpf1 protein is a nuclease inactive Cpf1. In some embodiments, the Cpf1 protein comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to the FnCpf1 sequence provided herein. In some embodiments, the Cpf1 protein comprises mutations corresponding to D917A, E1006A, D1255A, D917A/E1006A, D917A/D1255A, E1006A/D1255A, or D917A/E1006A/D1255A as numbered in the wild type FnCpf1 sequence provided herein. It should be appreciated that Cpf1 from other bacterial species may also be used in accordance with the present disclosure.

In some embodiments, the nucleic acid programmable DNA binding protein comprises a Cas12b (C2c1), C2c2, or C2c3 protein or a variant thereof. Additional features of Cas proteins in Class 2 CRISPR-Cas systems described in Shmakov et al., "Discovery and Functional Characterization of Diverse Class 2 CRISPR Cas Systems", Mol. Cell, 2015 Nov. 5; 60(3): 385-397, the entire contents of which is hereby incorporated by reference. Effectors of two of the systems, C2c1 and C2c3, contain RuvC-like endonuclease domains related to Cpf1. A third system, C2c2 contains an effector with two predicated HEPN RNase domains. Production of mature CRISPR RNA is tracrRNA-independent, unlike production of CRISPR RNA by C2c1. C2c1 depends on both CRISPR RNA and tracrRNA for DNA cleavage. The crystal structure of Alicyclobaccillus acidoterrastris C2c1 (AacC2c1) in complex with a chimeric single-molecule guide RNA (sgRNA) is described in Liu et al., "C2c1-sgRNA Complex Structure Reveals RNA-Guided DNA Cleavage Mechanism", Mol. Cell, 2017 Jan. 19; 65(2):310-322; Yang et al., "PAM-dependent Target DNA Recognition and Cleavage by C2C1 CRISPR-Cas, the entire contents of which are hereby incorporated by reference.

An exemplary Cas12b amino acid sequence (Bacillus hisashii Cas12b) is provided below:
BhCas12b (Bacillus hisashii) NCBI Reference Sequence: WP_095142515

```
                                          (SEQ ID NO: 54)
MAPKKKRKVGIHGVPAAATRSFILKIEPNEEVKKGLWKTHEVLNHGIAY

YMNILKLIRQEAIYEHHEQDPKNPKKVSKAEIQAELWDFVLKMQKCNSF

THEVDKDEVFNILRELYEELVPSSVEKKGEANQLSNKFLYPLVDPNSQS

GKGTASSGRKPRWYNLKIAGDPSWEEEKKKWEEDKKKDPLAKILGKLAE

YGLIPLFIPYTDSNEPIVKEIKWMEKSRNQSVRRLDKDMFIQALERFLS

WESWNLKVKEEYEKVEKEYKTLEERIKEDIQALKALEQYEKERQEQLLR

DTLNTNEYRLSKRGLRGWREIIQKWLKMDENEPSEKYLEVFKDYQRKHP

REAGDYSVYEFLSKKENHFIWRNHPEYPYLYATFCEIDKKKKDAKQQAT

FTLADPINHPLWVRFEERSGSNLNKYRILTEQLHTEKLKKKLTVQLDRL

IYPTESGGWEEKGKVDIVLLPSRQFYNQIFLDIEEKGKHAFTYKDESIK

FPLKGTLGGARVQFDRDHLRRYPHKVESGNVGRIYFNMTVNIEPTESPV

SKSLKIHRDDFPKVVNFKPKELTEWIKDSKGKKLKSGIESLEIGLRVMS

IDLGQRQAAAASIFEVVDQKPDIEGKLFFPIKGTELYAVHRASFNIKLP

GETLVKSREVLRKAREDNLKLMNQKLNFLRNVLHFQQFEDITEREKRVT

KWISRQENSDVPLVYQDELIQIRELMYKPYKDWVAFLKQLHKRLEVEIG

KEVKHWRKSLSDGRKGLYGISLKNIDEIDRTRKFLLRWSLRPTEPGEVR
```
```
                                        -continued
RLEPGQRFAIDQLNHLNALKEDRLKKMANTIIMHALGYCYDVRKKKWQA

KNPACQIILFEDLSNYNPYEERSRFENSKLMKWSRREIPRQVALQGEIY

GLQVGEVGAQFSSRFHAKTGSPGIRCSVVTKEKLQDNRFFKNLQREGRL

TLDKIAVLKEGDLYPDKGGEKFISLSKDRKCVTTHADINAAQNLQKRFW

TRTHGFYKVYCKAYQVDGQTVYIPESKDQKQKIIEEFGEGYFILKDGVY

EWVNAGKLKIKKGSSKQSSSELVDSDILKDSFDLASELKGEKLMLYRDP

SGNVFPSDKWMAAGVFFGKLERILISKLTNQYSISTIEDDSSKQSMKRP

AATKKAGQAKKKK
```

In some embodiments, the programmable DNA binding protein comprises an argonaute protein. One example of such a nucleic acid programmable DNA binding protein is an Argonaute protein from Natronobacterium gregoryi (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., Nat Biotechnol., 2016 July; 34(7):768-73. PubMed PMID: 27136078; Swarts et al., Nature. 507(7491) (2014): 258-61; and Swarts et al., Nucleic Acids Res. 43(10) (2015): 5120-9, each of which is incorporated herein by reference.

In some embodiments, the protospacer sequence comprises a nucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the protospacer sequences listed in Table 1 or Table 24. In some embodiments, the protospacer sequence comprises any one of the protospacer sequences listed in Table 1 or Table 24. In some embodiments, the protospacer sequence is any one of the protospacer sequences listed in Table 1 or Table 24. In some embodiments, the protospacer sequence comprises a nucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the sequences of SEQ ID NOs: 13-15, 50, 66-69, 81-252, and 1594-1617. In some embodiments, the protospacer sequence comprises any one of the sequences of SEQ ID NOs: 13-15, 50, 66-69, 81-252, and 1594-1617. In some embodiments, the protospacer sequence is any one of the sequences of SEQ ID NOs: 13-15, 50, 66-69, 81-252, and 1594-1617.

Guide Polynucleotides

Some aspects of this disclosure provide complexes comprising any of the fusion proteins provided herein, and a guide polynucleotide bound to a programmable DNA binding protein, e.g. a Cas9 domain of the base editor or fusion protein.

In some embodiments, a guide polynucleotide is a guide polynucleotide, a guide RNA (gRNA), or a nucleic acid encoding the same.

In some embodiments, the guide polynucleotide comprises a single nucleic acid sequence. In some embodiments, the guide polynucleotide comprises two nucleic acid sequences. In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide nucleic acid (e.g., guide RNA) is complementary to a sequence associated with a disease or disorder. In some embodiments, the guide nucleic acid (e.g., guide RNA) is complementary to a sequence associated with a disease or disorder having a mutation in a PCSK9 gene, a ANGPTL3 gene, or a APOC3 gene.

Some aspects of this disclosure provide methods of using the fusion proteins, or complexes comprising a guide nucleic acid (e.g., gRNA) and a nucleobase editor provided herein. For example, some aspects of this disclosure provide methods comprising contacting a DNA, or RNA molecule with any of the fusion proteins provided herein, and with at least one guide nucleic acid (e.g., guide RNA), wherein the guide nucleic acid, (e.g., guide RNA) is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

In some embodiments, a guide polynucleotide is a DNA. In some embodiments, a guide polynucleotide is an RNA. In some embodiments, a guide polynucleotide is a modified, artificial polynucleotides. In some embodiments, a guide polynucleotide is a single or single molecule polynucleotide. In some embodiments, a guide polynucleotide comprises dual polynucleotides. In some embodiments, a guide polynucleotide is a dual polynucleotides connected by a linker. In some embodiments, a guide polynucleotide is a dual polynucleotides connected by a non-nucleic acid linker. In some embodiments, a guide polynucleotide is a dual polynucleotides connected by a peptide linker or a chemical linker.

In some embodiments, the guide polynucleotide is a single guide RNA. The guide RNA (gRNA) may guide the programmable DNA binding protein, e.g., a Class 2 Cas nuclease, e.g. a Cas9 to a target sequence on a target nucleic acid molecule, where the gRNA hybridizes with and the programmable DNA binding protein and modifies the target sequence. In some embodiments, the gRNA and the base editor fusion protein may form a ribonucleoprotein (RNP), e.g., a CRISPR/Cas complex. In some embodiments, the CRISPR complex may be a Type II CRISPR/Cas9 complex. In some embodiments, the CRISPR/Cas complex may be a Type V CRISPR/Cas complex, such as a Cpf1/guide RNA complex.

A gRNA can comprise at least three regions: a first region at the 5' end that can bind to the complementary strand of a target site in a chromosomal sequence (spacer region), a second internal region that can form a stem loop structure, and a third 3' region that can be single-stranded. A first region of each guide RNA can also be different such that each gRNA guides a protein, e.g., Cas9, to a specific target site. Further, second and third regions of each gRNA can be identical in all gRNAs. A second region of a gRNA may form a secondary structure. In some embodiments, a secondary structure formed by a gRNA can comprise a stem (or hairpin) and a loop. A length of a loop and a stem can vary. In some embodiments, a loop can range from about 3 to about 10 nucleotides in length. In some embodiments, a stem can range from about 6 to about 20 nucleotides in length. A stem can comprise one or more bulges of 1 to 10 nucleotides or about 10 nucleotides. In some embodiments, the overall length of a second region can range from about 16 to 60 nucleotides in length. In some embodiments, a loop can be about 4 nucleotides in length. In some embodiments, a stem can be about 12 in length. A third region of gRNA at the 3' end can be essentially single-stranded. In some embodiments, a third region is sometimes not complementary to any chromosomal sequence in a cell of interest and is sometimes not complementary to the rest of a gRNA. In addition, the length of a third region can vary. In some embodiments, a third region can be more than 3 or more than 4 nucleotides in length. For example, the length of a third region can range from about 5 to 60 nucleotides in length.

A gRNA for a base editor system can comprise a CRISPR RNA (crRNA) and a trans-activating crRNA (tracrRNA). In some embodiments, the crRNA may comprise a targeting sequence (or spacer sequence) that hybridizes with the complementary strand of the target sequence on the target nucleic acid molecule. The crRNA may also comprise a flagpole that is complementary to and hybridizes with a portion of the tracrRNA. In some embodiments, the crRNA may parallel the structure of a naturally occurring crRNA transcribed from a CRISPR locus of a bacteria, where the targeting sequence acts as the protospacer of the Cas9 in the base editor system. The gRNA may target any sequence of interest via the targeting sequence of the crRNA. In some embodiments, the degree of complementarity between the targeting sequence of the gRNA and the target sequence on the target nucleic acid molecule is at least about 60%, 65%, 70%, 75%, 80%, 85%, 90%, 95%, 97%, 98%, 99%, or 100%. In some embodiments, the targeting sequence of the gRNA and the target sequence on the target nucleic acid molecule may be 100% complementary. In other embodiments, the targeting sequence of the gRNA and the target sequence on the target nucleic acid molecule may contain at least one mismatch. For example, the targeting sequence of the gRNA and the target sequence on the target nucleic acid molecule may contain 1, 2, 3, 4, 5, 6, 7, 8, 9, or 10 mismatches.

In some embodiments, the length of the targeting sequence depends on the CRISPR/Cas component of the base editor system and components used. For example, different Cas proteins from different bacterial species have varying optimal targeting sequence lengths. Accordingly, the targeting sequence may comprise 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more than 50 nucleotides in length. In some embodiments, the targeting sequence comprised 18-24 nucleotides in length. In some embodiments, the targeting sequence comprises 19-21 nucleotides in length. In some embodiments, the targeting sequence comprises 20 nucleotides in length.

In some embodiments, the guide RNA is a "dual guide RNA" or "dgRNA". In some embodiments, the dgRNA comprises a first RNA molecule comprising a crRNA, and a second RNA molecule comprising a tracrRNA. The first and second RNA molecules may form a RNA duplex via the base pairing between the crRNA and the tracrRNA (e.g. the repeat and anti repeat). In some embodiments, the guide RNA is a "single guide RNA" or "sgRNA." In some embodiments, the sgRNA may comprise a crRNA covalently linked to a tracrRNA. In some embodiments, the crRNA and the tracrRNA may be covalently linked via a linker. In some embodiments, the single-molecule guide RNA may comprise a stem-loop structure via the base pairing between the crRNA and the tracrRNA. In some embodiments, the sgRNA is a "Cas9 sgRNA" capable of directing a Cas9 protein. In certain embodiments, the guide RNA comprises a crRNA and tracrRNA sufficient for forming an active complex with a Cas9 protein and mediating RNA-guided DNA modification. The term "gRNA" and "sgRNA" are used interchangeably throughout this application. In some embodiments, more than one guide RNAs can be used; each guide RNA contains a different targeting sequence, such that the base editor system modifies more than one target sequence. In some embodiments, one or more guide RNAs may have the same or differing properties such as activity or stability within a base editor complex. Where more than one guide RNA is used, each guide RNA can be encoded on the same or on different expression cassettes. The promoters used to drive expression of the more than one guide RNA may be the same or different.

In some embodiments, the gRNA or mRNA encoding Cas protein is modified. The modifications can comprise chemical alterations, synthetic modifications, nucleotide additions, and/or nucleotide subtractions and modified nucleosides or nucleotides can be present in a gRNA. A gRNA or Cas protein-encoding mRNA comprising one or more modified nucleosides or nucleotides is called a "modified" RNA to describe the presence of one or more non-naturally and/or naturally occurring components or configurations that are used instead of or in addition to the canonical A, G, C, and U residues. In some embodiments, a modified RNA is synthesized with a non-canonical nucleoside or nucleotide. Modified nucleosides and nucleotides can include one or more of: (i) alteration, e.g., replacement, of one or both of the non-linking phosphate oxygens and/or of one or more of the linking phosphate oxygens in the phosphodiester backbone linkage (an exemplary backbone modification); (ii) alteration, e.g., replacement, of a constituent of the ribose sugar, e.g., of the 2' hydroxyl on the ribose sugar (an exemplary sugar modification); (iii) wholesale replacement of the phosphate moiety with "dephospho" linkers (an exemplary backbone modification); (iv) modification or replacement of a naturally occurring nucleobase, including with a non-canonical nucleobase (an exemplary base modification); (v) replacement or modification of the ribose-phosphate backbone (an exemplary backbone modification); (vi) modification of the 3' end or 5' end of the oligonucleotide, e.g., removal, addition, modification, or replacement of a terminal phosphate group or conjugation of a moiety, cap, or linker (such 3' or 5' cap modifications may comprise a sugar and/or backbone modification); and (vii) modification or replacement of the sugar (an exemplary sugar modification). The modifications can enhance genome editing by CRISPR/Cas. A modification can alter chirality of a gRNA. In some cases, chirality may be uniform or stereopure after a modification. A guide RNA can also be truncated. Truncation can be used to reduce undesired off-target mutagenesis. The truncation can comprise any number of nucleotide deletions. For example, the truncation can comprise 1, 2, 3, 4, 5, 10, 15, 20, 25, 30, 40, 50 or more nucleotides. In some embodiments, the term "cap," as used herein, may be used to refer to one or more specially altered or modified nucleotides, e.g., specially altered or modified nucleotides on the 5' end of mRNA. In some embodiments, the cap comprises to a modified guanine (G) nucleotide. In some embodiments, the cap refers to the 5' end modification of mRNAs by addition of 7-Methylguanosine (N7-methyl guanosine or m7G). In some embodiments, "capping" of the mRNA structure plays a crucial role in a variety of cellular processes which include translation initiation, splicing, intracellular transport, and turnover. In some embodiment, the 5' cap enhances mRNA stability as well as translation efficiency. Exemplary cap analogs include, but are not limited to, standard cap analog m7G(5')ppp(5')G, anti-reverse cap analog (ARCA) m7,3'-OGpppG (or 3'-O-Me-m7G(5') ppp(5') G), unmethylated cap analog G (5')ppp(5')G, methylated cap analog for A+1 sites m7G(5')ppp(5')A, and unmethylated cap analog for A+1 sites G(5')ppp(5')A. Additional methods of obtaining mRNA cap analogs are described in Kowalska et al., RNA 2008 14(6): 1119-1131, which is incorporated herein in its entirety.

In some embodiments, the guide RNA sequence comprises a nucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the guide sequences listed in Table 1 or Table 24. In some embodiments, the guide RNA sequence comprises any one of the guide RNA sequences listed in Table 1 or Table 24. In some embodiments, the guide RNA sequence is any one of the guide RNA sequences listed in Table 1 or Table 24. In some embodiments, the guide RNA sequence comprises a nucleotide sequence that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the sequences of SEQ ID NOs: 9-11, 55, 59, 253-452, 1618-1635, 1637-1800, 1802-2135, and 2191. In some embodiments, the guide RNA sequence comprises any one of the sequences of SEQ ID NOs: 9-11, 55, 59, 253-452, 1618-1635, 1637-1800, 1802-2135, and 2191. In some embodiments, the guide RNA sequence is any one of the sequences of SEQ ID NOs: 9-11, 55, 59, 253-452, 1618-1635, 1637-1800, 1802-2135, and 2191.

Off-target Effects

With standard CRISPR-Cas9 genome editing, off-target mutagenesis—i.e., edits at genomic sites other than the intended target site-can occur at sites that share a high degree of sequence similarity with the protospacer sequence encoded in the gRNA.

As used herein, off-target effect may be used refer to modifications, including indels, at genomic sites other than intended target site, for example, a protospacer sequence recognized by the guide RNA sequence. In the context of base editing, off-target editing may occur at genomic sites remote from an intended target site, or in close proximity to the intended target site. For example, one or more bases besides the target nucleobase in the base editing window may be edited ("bystander editing"). In certain embodiments, off-target base editing, e.g. bystander editing does not impact expression or function of the target gene.

Potential off-target sequence candidates in the genome may be predicted by bioinformatic analyses of the human genome using, e.g., the MIT Specificity Score (calculated by http://crispor.tefor.net/; minimum score of 50) or by in vitro biochemical assays, e.g., ONE-seq.

Off-target editing may be determined by sequencing analysis. In some embodiments, off-target editing is calculated using net nucleobase editing at potential off-target sites in the genome. For example, net nucleobase editing efficiency may be determined using no-base editor or no-guide RNA as a control, where net nucleobase editing efficiency is obtained by editing rate observed in cells contacted with a LNP enclosing a base editor mRNA and a guide RNA subjected by editing rate observed in control cells at predicted off-target sites. Additional methods for estimating and reducing off-target editing are described in Rees et al., Nat. Rev. Genet. 2018 19(12): 770-788, which is incorporated herein by reference in its entirety.

Methods for selecting, designing, and validating gRNAs and targeting sequences (or spacer sequences) are described herein and known to those skilled in the art. Software tools can be used to optimize the gRNAs corresponding to a target nucleic acid sequence, e.g., to minimize total off-target activity across the genome. For example, for each possible targeting domain choice using *S. pyogenes* Cas9, all off-target sequences (preceding selected PAMs, e.g., NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g., crRNAs) can be ranked according to its total predicted off-target score; the top-ranked targeting domains represent those that are likely to have the greatest on-target and the least off-target activity. In some embodiments, a DNA sequence searching algorithm can be used to identify a target sequence in crRNAs of a gRNA for use with Cas9. A custom gRNA design software based on the public tool cas-offinder, which scores guides after calculating their genome-wide off-target propensity, can be also used to design a gRNA (Bae, et al., Cas-OFFinder: A fast and versatile algorithm that searches for potential off-target sites of Cas9 RNA-guided endonucleases. Bioinformatics 30, 1473-1475 (2014)). In some embodiments, RepeatMasker program can be used to screen repeat elements and regions of low complexity in the input DNA sequences. In addition, the number of residues that could unintentionally be targeted (e.g., off-target residues that could potentially reside on ssDNA within the target nucleic acid locus) may be minimized to reduce the impact of potential substrate promiscuity of a deaminase domain in the nucleobase editor system. Candidate gRNAs can be functionally evaluated by using methods known in the art and/or as set forth herein.

In some embodiments, target sequences for a Cas9 protein in a base editor system can be selected based on the presence of target sequences of a gene of interest in one or more species. For example, a sequence may be selected as a target sequence if the sequence match target sequences in both human and cynomolgus monkey orthologs of a gene of interest. In some embodiments, target sequences for a Cas9 nuclease can be selected based on predicted off-target profiles, as judged by the MIT Specificity Score (calculated by http://crispor.tefor.net/). For example, a sequence may be selected as a target sequence if the sequence has a favorable predicted off-target profiles (e.g., minimum score of 50 when judged by the MIT Specificity Score). In some embodiments, target sequences for an adenine base editor (ABE) can be selected based on the ability of editing an adenine base within a splice donor site or a splice acceptor site in a target gene. In some embodiments, target sequences for an ABE can be selected based on the position of an adenine, e.g., if the adenine lies within the editing window of the ABE.

The gRNAs described herein can be synthesized chemically, enzymatically, or a combination thereof. For example, the gRNA can be synthesized using standard phosphoramidite-based solid-phase synthesis methods. Alternatively, the gRNA can be synthesized in vitro by operably linking DNA encoding the gRNA to a promoter control sequence that is recognized by a phage RNA polymerase. Examples of suitable phage promoter sequences include, but are not limited to, T7, T3, SP6 promoter sequences, or variations thereof. In some embodiments, gRNA comprises two separate molecules (e.g., crRNA and tracrRNA) and one molecule (e.g., crRNA) can be chemically synthesized and the other molecule (e.g., tracrRNA) can be enzymatically synthesized.

In some aspects, provided herein, is a composition for gene modification comprising a single guide RNA (sgRNA) described herein and the base editor fusion protein or a nucleic acid sequence encoding the base editor fusion protein. In some embodiments, the composition further comprises a vector that comprises the nucleic acid sequence encoding the base editor fusion protein. In some embodiments, base editor fusion protein comprises a Cas9 protein. In some embodiments, the Cas9 protein is a the Cas9 protein is a *Streptococcus pyogenes* Cas9. In some embodiments, the composition further comprises a pharmaceutically acceptable carrier. Non-limiting examples of pharmaceutically acceptable carriers are listed in "Pharmaceutical composition and methods of treatment" section of this application. In some embodiments, the composition described herein can be provided in a lipid nanoparticle.

Chemically Modified Guide RNAs (2RNAs)

The present disclosure, provided herein, relates to a chemically modified CRISPR guide RNA (gRNA) that may be used in association with any general CRISPR/Cas system, for example, a base editor system as described herein. gRNAs (e.g., sgRNAs, short-sgRNAs, crRNAs, tracrRNAs, or dgRNAs) may comprise modifications at various nucleotide positions. In some aspects, provided herein, is a guide RNA (gRNA) or a single guide RNA (sgRNA) that comprises (i) a chemical modification at a nucleotide and (ii) an unmodified nucleotide. In some embodiments, the gRNA or the sgRNA may comprise a modification at a specific nucleotide position. In some embodiments, the gRNA or the sgRNA may comprise one or more modifications at one or more specific positions.

In an aspect, chemically modified CRISPR guide RNAs provided herein comprise modifications based on crystal structures. Not intended to be bound by a particular theory, X-ray crystal structure based guide design may be used to optimize gRNA modification in complex with the Cas protein, e.g. Cas9. In some embodiments, a nucleotide where a 2'-OH is in close proximity with a Cas9 protein in the Cas9-gRNA complex is unmodified. In some embodiments, a nucleotide where a 2'-OH is in contact with a Cas9 protein in the Cas9-gRNA complex is unmodified. In some embodiments, a nucleotide where a 2'-OH is in contact with a Cas9 protein with a hydrogen bond in the Cas9-gRNA complex is unmodified. In some embodiments, the Cas9-gRNA complex is a pre-catalytic ternary complex. In some embodiments, a nucleotide where a 2'-OH is in close proximity with another part of the gRNA in the Cas9-gRNA complex is unmodified. In some embodiments, a nucleotide where a 2'-OH is in contact with another part of the gRNA in the Cas9-gRNA complex is unmodified. In some embodiments, a nucleotide where a 2'-OH is in contact with another part of the gRNA with a hydrogen bond in the Cas9-gRNA complex is unmodified. In some embodiments, the Cas9-gRNA complex is a pre-catalytic ternary complex. As a person of skill in the art would understand, the term "clash" as used herein refers to physically-unlikely overlapping atomic volumes in a structure. Incorporation of a 2'O-Me modification in these situations would potentially result in structural rearrangement(s) that could be detrimental to RNP function. As a person of skill in the art would understand, the term "contact" as used herein means a stable, non-covalent interaction between two functional groups, e.g. a hydrogen bond. In some embodiments, a nucleotide where a clash with another part of the gRNA is predicted if a 2'-OH is replaced with a 2'-OMe in the Cas9-gRNA complex is unmodified. In some embodiments, a nucleotide where a clash with another 2'-OH in the gRNA is predicted if a 2'-OH is replaced with a 2'-OMe in the Cas9-gRNA complex is unmodified. In some embodiments, the Cas9-gRNA complex is a pre-catalytic ternary complex. In some embodiments, a nucleotide that is solvent-exposed or otherwise distant from Cas protein residues in the Cas9-gRNA complex comprises a chemical modification. In some embodiments, a nucleotide that is solvent-exposed or otherwise distant from another nucleotide in the gRNA in the Cas9-gRNA complex comprises a chemical modification. In some embodiments, the chemical modification is a 2'-OMe modification. Additional description of Cas9-gRNA crystal structure is included in Jiang F, Taylor D W, Chen J S, Kornfeld J E, Zhou K, Thompson A J, Nogales E, Doudna J A. Structures of a CRISPR-Cas9 R-loop complex primed for DNA cleavage. Science. 2016 Feb. 19; 351(6275):867-71, incorporated herein by reference in its entirety.

Modifications to guide RNA nucleotides can include, but are not limited to, 2'-O-methyl modifications, 2'-O-(2-methoxyethyl) modifications, 2'-fluoro modifications, phosphorothioate modifications, inverted abasic modifications, deoxyribonucleotides, bicylic ribose analog (e.g., locked nucleic acid (LNA), C-ethylene-bridged nucleic acid (ENA), bridged nucleic acid (BNA), unlocked nucleic acid (UNA)), base or nucleobase modifications, internucleoside linkage modifications, ribonebularine, 2'-O-methylnebularine, or 2'-deoxynebularine. Other examples of modifications include, but are not limited to, 5'adenylate, 5' guanosine-triphosphate cap, 5'N7-Methylguanosine-triphosphate cap, 5'triphosphate cap, 3'phosphate, 3'thiophosphate, 5'phosphate, 5'thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2'deoxyribonucleoside analog purine, 2'deoxyribonucleoside analog pyrimidine, ribonucleoside analog, 2'-O-methyl ribonucleoside analog, sugar modified analogs, wobble/universal bases, fluorescent dye label, 2'fluoro RNA, 2'O-methyl RNA, methylphosphonate, phosphodiester DNA, phosphodiester RNA, phosphothioate DNA, phosphorothioate RNA, UNA, pseudouridine-5'-triphosphate, 5-methylcytidine-5'-triphosphate, 2-O-methyl 3phosphorothioate or any combinations thereof.

In some embodiments, the ribose group (or sugar) may be modified. In some embodiments, modified ribose group may control oligonucleotide binding affinity for complementary strands, duplex formation, or interaction with nucleases. Examples of chemical modifications to the ribose group include, but are not limited to, 2'-O-methyl (2'-OMe), 2'-fluoro (2'-F), 2'-deoxy, 2'-O-(2-methoxyethyl) (2'-MOE), 2'-NH2, 2'-O-Allyl, 2'-O-Ethylamine, 2'-O-Cyanoethyl, 2'-O-Acetalester, or a bicyclic nucleotide such as locked nucleic acid (LNA), 2'-(5-constrained ethyl (S-cEt)), constrained MOE, or 2'-0,4'-C-aminomethylene bridged nucleic acid (2',4'-BNANC). In some embodiments, 2'-O-methyl modification can increase binding affinity of oligonucleotides. In some embodiments, 2'-O-methyl modification can enhance nuclease stability of oligonucleotides. In some embodiments, 2'-fluoro modification can increase oligonucleotide binding affinity and nuclease stability. In this application, a ribonucleotide in lowercase in gRNA sequence depicts 2'-OMe modification (e.g., Table 1 or Table 24) (lowercase letter s indicates a phosphorothioate linkage).

In some embodiments, the phosphate group may be chemically modified. Examples of chemical modifications to the phosphate group includes, but are not limited to, a phosphorothioate (PS), phosphonoacetate (PACE), thiophosphonoacetate (thioPACE), amide, triazole, phosphonate, or phosphotriester modification. In some embodiments, PS linkage can refer to a bond where a sulfur is substituted for one nonbridging phosphate oxygen in a phosphodiester linkage, e.g., between nucleotides. An "s" may be used to depict a PS modification in gRNA sequences in this application (e.g., Table 1 or Table 24). In some embodiments, a gRNA or an sgRNA may comprise a phosphorothioate (PS) linkage at a 5' end or at a 3' end. In some embodiments, a gRNA or an sgRNA may comprise a phosphorothioate (PS) linkage at a 5' end. In some embodiments, a gRNA or an sgRNA may comprise a phosphorothioate (PS) linkage at a 3' end. In some embodiments, a gRNA or an sgRNA may comprise a phosphorothioate (PS) linkage at a 5' end and at a 3' end. In some embodiments, a gRNA or an sgRNA may comprise one, two, or three, or more than three phosphorothioate linkages at the 5' end or at the 3' end. In some embodiments, a gRNA or an sgRNA may comprise three phosphorothioate (PS) linkages at the 5' end or at the 3' end. In some embodiments, a gRNA or an sgRNA may comprise three phosphorothioate linkages at the 3' end. In some embodiments, a gRNA or an sgRNA may comprise two and no more than two (i.e., only two) contiguous phosphorothioate (PS) linkages at the 5' end or at the 3' end. In some embodiments, a gRNA or an sgRNA may comprise three contiguous phosphorothioate (PS) linkages at the 5' end or at the 3' end. In some embodiments, a gRNA or an sgRNA may comprise the sequence 5'-UsUsU-3' at the 3'end or at the 5' end, wherein U indicates a uridine and wherein s indicates a phosphorothioate (PS) linkage. In some embodiments, a gRNA or an sgRNA may comprise the sequence 5'-ususu-3' at the 3'end or at the 5' end, wherein u indicates a 2'-O-methyluridine and wherein s indicates a phosphorothioate (PS) linkage. In some embodiments, a gRNA or an sgRNA may comprise the sequence 5'-ususuUUU-3' at the 3'end or at the 5' end, wherein U and u indicate uridine and 2'-O-methyluridine respectively, and wherein s indicates a phosphorothioate (PS) linkage. In some embodiments, a gRNA or an sgRNA may comprise the sequence 5'-ususuUuU-3' at the 3'end or at the 5' end, wherein U and u indicate uridine and 2'-O-methyluridine respectively, and wherein s indicates a phosphorothioate (PS) linkage. In some embodiments, a gRNA or an sgRNA may comprise the sequence 5'-ususususuUuU-3' at the 3'end, wherein U and u indicate uridine and 2'-O-methyluridine respectively, and wherein s indicates a phosphorothioate (PS) linkage. In some embodiments, a gRNA or an sgRNA may comprise the sequence 5'-ususuuuu-3' at the 3'end, wherein u indicates 2'-O-methyluridine, and wherein s indicates a phosphorothioate (PS) linkage.

In some embodiments, the nucleobase may be chemically modified. Examples of chemical modifications to the nucleobase include, but are not limited to, 2-thiouridine, 4-thiouridine, N6-methyladenosine, pseudouridine, 2,6-diaminopurine, inosine, thymidine, 5-methylcytosine, 5-substituted pyrimidine, isoguanine, isocytosine, or halogenated aromatic groups.

In some embodiments the chemically modified gRNAs comprise nebularine. Nebularine is a purine ribonucleoside that is derived from a beta-D-ribose and is 9H-purine attached to a beta-D-ribofuranosyl residue at position 9 via a glycosidic (N-glycosyl) linkage. Nebularine is a purine ribonucleoside with no exocyclic functional moiety or substitution. In some embodiments, it is a purine ribonucleoside. In some embodiments, it is a purine D-ribonucleoside. In some embodiments, nebularine is further modified chemically. In this application, "X," "x," and "dX" may be used to depict a ribonebularine modification, a 2'-O-methylnebularine modification, and a 2'-deoxynebularine modification, respectively, in gRNA sequences (e.g., Table 1 or Table 24). In some embodiments, substitution of a nucleotide (e.g., A) of a gRNA sequence (e.g., spacer region or tracr region) with nebularine may reduce off-target effects without affecting the gRNA activity. In some embodiments, the nebularine, the deoxynebularine, or 2'-O-methylnebularine replaces an adenine in an unmodified gRNA or sgRNA. In some embodiments, the nebularine, the deoxynebularine, or 2'-O-methylnebularine is in the spacer sequence. In some embodiments, the nebularine, the deoxynebularine, or 2'-O-methylnebularine is in the tracrRNA sequence. In some embodiments, the nebularine, the deoxynebularine, or 2'-O-methylnebularine is in a tracrRNA sequence in the tracrRNA sequence. In some embodiments, the nebularine, the deoxynebularine, or 2'-O-methylnebularine is in a crRNA sequence in the tracrRNA sequence. In some embodiments, the nebularine, the deoxynebularine, or 2'-O-methylnebularine is in a stem loop structure in the tracrRNA sequence.

In some embodiments, the chemically modified gRNAs may comprise a total of 50-150 base pairs in length. In some embodiments, the chemically modified gRNAs may comprise a total of 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 base pairs in length. In some embodiments, the chemically modified gRNAs may comprise a total of about 50 to about 140 base pairs in length. In some embodiments, the chemically modified gRNAs may comprise a total of about 50 to about 60, about 50 to about 70, about 50 to about 80, about 50 to about 90, about 50 to about 100, about 50 to about 110, about 50 to about 120, about 50 to about 130, about 50 to about 140, about 60 to about 70, about 60 to about 80, about 60 to about 90, about 60 to about 100, about 60 to about 110, about 60 to about 120, about 60 to about 130, about 60 to about 140, about 70 to about 80, about 70 to about 90, about 70 to about 100, about 70 to about 110, about 70 to about 120, about 70 to about 130, about 70 to about 140, about 80 to about 90, about 80 to about 100, about 80 to about 110, about 80 to about 120, about 80 to about 130, about 80 to about 140, about 90 to about 100, about 90 to about 110, about 90 to about 120, about 90 to about 130, about 90 to about 140, about 100 to about 110, about 100 to about 120, about 100 to about 130, about 100 to about 140, about 110 to about 120, about 110 to about 130, about 110 to about 140, about 120 to about 130, about 120 to about 140, or about 130 to about 140 base pairs in length. In some embodiments, the chemically modified gRNAs may comprise a total of about 50, about 60, about 70, about 80, about 90, about 100, about 110, about 120, about 130, or about 140 base pairs in length. In some embodiments, the chemically modified gRNAs may comprise a total of at least about 50, about 60, about 70, about 80, about 90, about 100, about 110, about 120, or about 130 base pairs in length. In some embodiments, the chemically modified gRNAs may comprise a total of at most about 60, about 70, about 80, about 90, about 100, about 110, about 120, about 130, or about 140 base pairs in length. In one embodiment, the chemically modified gRNAs may comprise a total of 100 base pairs in length. In another embodiment, the chemically modified gRNAs may comprise a total of 103 base pairs in length.

In some embodiments, the chemically modified gRNAs may comprise from 1 to 150 chemically modified nucleotides. In some embodiments, the chemically modified gRNAs may comprise a total of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 chemically modified nucleotides. In some embodiments, the chemically modified gRNAs may comprise a total of about 1 to about 45 chemically modified nucleotides. In some embodiments, the chemically modified gRNAs may comprise a total of about 1 to about 3, about 1 to about 5, about 1 to about 10, about 1 to about 15, about 1 to about 20, about 1 to about 25, about 1 to about 30, about 1 to about 35, about 1 to about 40, about 1 to about 45, about 3 to about 5, about 3 to about 10, about 3 to about 15, about 3 to about 20, about 3 to about 25, about 3 to about 30, about 3 to about 35, about 3 to about 40, about 3 to about 45, about 5 to about 10, about 5 to about 15, about 5 to about 20, about 5 to about 25, about 5 to about 30, about 5 to about 35, about 5 to about 40, about 5 to about 45, about 10 to about 15, about 10 to about 20, about 10 to about 25, about 10 to about 30, about 10 to about 35, about 10 to about 40, about 10 to about 45, about 15 to about 20, about 15 to about 25, about 15 to about 30, about 15 to about 35, about 15 to about 40, about 15 to about 45, about 20 to about 25, about 20 to about 30, about 20 to about 35, about 20 to about 40, about 20 to about 45, about 25 to about 30, about 25 to about 35, about 25 to about 40, about 25 to about 45, about 30 to about 35, about 30 to about 40, about 30 to about 45, about 35 to about 40, about 35 to about 45, about 40 to about 45, or about 45 to about 50 chemically modified nucleotides. In some embodiments, the chemically modified gRNAs may comprise a total of about 1, about 3, about 5, about 10, about 15, about 20, about 25, about 30, about 35, about 40, about 45, or about 50 chemically modified nucleotides. In some embodiments, the chemically modified gRNAs may comprise a total of at least about 1, about 3, about 5, about 10, about 15, about 20, about 25, about 30, about 35, about 40, about 45, or about 50 chemically modified nucleotides. In some embodiments, the chemically modified gRNAs may comprise a total of at most about 3, about 5, about 10, about 15, about 20, about 25, about 30, about 35, about 40, about 45, or about 50 chemically modified nucleotides. In some embodiments, the chemically modified gRNAs may comprise a total of about 50 to about 140 chemically modified nucleotides. In some embodiments, the chemically modified gRNAs may comprise a total of about 50 to about 60, about 50 to about 70, about 50 to about 80, about 50 to about 90, about 50 to about 100, about 50 to about 110, about 50 to about 120, about 50 to about 130, about 50 to about 140, about 60 to about 70, about 60 to about 80, about 60 to about 90, about 60 to about 100, about 60 to about 110, about 60 to about 120, about 60 to about 130, about 60 to about 140, about 70 to about 80, about 70 to about 90, about 70 to about 100, about 70 to about 110, about 70 to about 120, about 70 to about 130, about 70 to about 140, about 80 to about 90, about 80 to about 100, about 80 to about 110, about 80 to about 120, about 80 to about 130, about 80 to about 140, about 90 to about 100, about 90 to about 110, about 90 to about 120, about 90 to about 130, about 90 to about 140, about 100 to about 110, about 100 to about 120, about 100 to about 130, about 100 to about 140, about 110 to about 120, about 110 to about 130, about 110 to about 140, about 120 to about 130, about 120 to about 140, or about 130 to about 140 chemically modified nucleotides. In some embodiments, the chemically modified gRNAs may comprise a total of about 50, about 60, about 70, about 80, about 90, about 100, about 110, about 120, about 130, or about 140 chemically modified nucleotides. In some embodiments, the chemically modified gRNAs may comprise a total of at least about 50, about 60, about 70, about 80, about 90, about 100, about 110, about 120, or about 130 chemically modified nucleotides. In some embodiments, the chemically modified gRNAs may comprise a total of at most about 60, about 70, about 80, about 90, about 100, about 110, about 120, about 130, or about 140 chemically modified nucleotides. In one embodiment, the chemically modified gRNAs may comprise a total of 54 chemically modified nucleotides. In another embodiment, the chemically modified gRNAs may comprise a total of 62 chemically modified nucleotides.

In some embodiments, the chemically modified gRNAs may comprise about 1% to about 100% chemically modified nucleotides. In some embodiments, the chemically modified gRNAs may comprise about 1% to about 10%, about 1% to about 20%, about 1% to about 30%, about 1% to about 40%, about 1% to about 50%, about 1% to about 60%, about 1% to about 70%, about 1% to about 80%, about 1% to about 90%, about 1% to about 95%, about 1% to about 100%, about 10% to about 20%, about 10% to about 30%, about 10% to about 40%, about 10% to about 50%, about 10% to about 60%, about 10% to about 70%, about 10% to about 80%, about 10% to about 90%, about 10% to about 95%, about 10% to about 100%, about 20% to about 30%, about 20% to about 40%, about 20% to about 50%, about 20% to about 60%, about 20% to about 70%, about 20% to about 80%, about 20% to about 90%, about 20% to about 95%, about 20% to about 100%, about 30% to about 40%, about 30% to about 50%, about 30% to about 60%, about 30% to about 70%, about 30% to about 80%, about 30% to about 90%, about 30% to about 95%, about 30% to about 100%, about 40% to about 50%, about 40% to about 60%, about 40% to about 70%, about 40% to about 80%, about 40% to about 90%, about 40% to about 95%, about 40% to about 100%, about 50% to about 60%, about 50% to about 70%, about 50% to about 80%, about 50% to about 90%, about 50% to about 95%, about 50% to about 100%, about 60% to about 70%, about 60% to about 80%, about 60% to about 90%, about 60% to about 95%, about 60% to about 100%, about 70% to about 80%, about 70% to about 90%, about 70% to about 95%, about 70% to about 100%, about 80% to about 90%, about 80% to about 95%, about 80% to about 100%, about 90% to about 95%, about 90% to about 100%, or about 95% to about 100% chemically modified nucleotides. In some embodiments, the chemically modified gRNAs may comprise about 1%, about 10%, about 20%, about 30%, about 40%, about 50%, about 60%, about 70%, about 80%, about 90%, about 95%, or about 100% chemically modified nucleotides. In some embodiments, the chemically modified gRNAs may comprise at least about 1%, about 10%, about 20%, about 30%, about 40%, about 50%, about 60%, about 70%, about 80%, about 90%, or about 95% chemically modified nucleotides. In some embodiments, the chemically modified gRNAs may comprise at most about 10%, about 20%, about 30%, about 40%, about 50%, about 60%, about 70%, about 80%, about 90%, about 95%, or about 100% chemically modified nucleotides.

In some embodiments, the chemically modified gRNAs may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 in the 5'-3' direction in the gRNA sequence.

In some embodiments, the chemically modified gRNAs may have chemically modified nucleotide on one or more of the positions which are 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, or 149 base pairs from the 5' end of the gRNA sequence.

In some embodiments, the chemically modified gRNAs may have chemically modified nucleotide on one or more the positions where are 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, or 149 base pairs from the 3' end of the gRNA sequence.

In some embodiments, the chemically modified gRNA may be a sgRNA. The term "gRNA" and "sgRNA" are used interchangeably in this application. In some embodiments, the sgRNA may comprise one or more chemically modified nucleotides. In some embodiments, the chemically modified sgRNA may comprise a total of 50-150 base pairs in length. In some embodiments, the chemically modified sgRNA may comprise a total of 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 base pairs in length. In some embodiments, the chemically modified sgRNA may comprise a total of about 50 to about 140 base pairs in length. In some embodiments, the chemically modified sgRNA may comprise a total of about 50 to about 60, about 50 to about 70, about 50 to about 80, about 50 to about 90, about 50 to about 100, about 50 to about 110, about 50 to about 120, about 50 to about 130, about 50 to about 140, about 60 to about 70, about 60 to about 80, about 60 to about 90, about 60 to about 100, about 60 to about 110, about 60 to about 120, about 60 to about 130, about 60 to about 140, about 70 to about 80, about 70 to about 90, about 70 to about 100, about 70 to about 110, about 70 to about 120, about 70 to about 130, about 70 to about 140, about 80 to about 90, about 80 to about 100, about 80 to about 110, about 80 to about 120, about 80 to about 130, about 80 to about 140, about 90 to about 100, about 90 to about 110, about 90 to about 120, about 90 to about 130, about 90 to about 140, about 100 to about 110, about 100 to about 120, about 100 to about 130, about 100 to about 140, about 110 to about 120, about 110 to about 130, about 110 to about 140, about 120 to about 130, about 120 to about 140, or about 130 to about 140 base pairs in length. In some embodiments, the chemically modified sgRNAs may comprise a total of about 50, about 60, about 70, about 80, about 90, about 100, about 110, about 120, about 130, or about 140 base pairs in length. In some embodiments, the chemically modified sgRNAs may comprise a total of at least about 50, about 60, about 70, about 80, about 90, about 100, about 110, about 120, or about 130 base pairs in length. In some embodiments, the chemically modified sgRNA may comprise a total of at most about 60, about 70, about 80, about 90, about 100, about 110, about 120, about 130, or about 140 base pairs in length. In one embodiment, the chemically modified sgRNA may comprise a total of 100 base pairs in length. In another embodiment, the chemically modified sgRNA may comprise a total of 103 base pairs in length.

In some embodiments, the chemically modified sgRNAs may comprise a total of from 1 to 150 chemically modified nucleotides. In some embodiments, the chemically modified sgRNAs may comprise a total of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 chemically modified nucleotides. In some embodiments, the chemically modified sgRNAs may comprise a total of about 1 to about 45 chemically modified nucleotides. In some embodiments, the chemically modified sgRNAs may comprise a total of about 1 to about 3, about 1 to about 5, about 1 to about 10, about 1 to about 15, about 1 to about 20, about 1 to about 25, about 1 to about 30, about 1 to about 35, about 1 to about 40, about 1 to about 45, about 3 to about 5, about 3 to about 10, about 3 to about 15, about 3 to about 20, about 3 to about 25, about 3 to about 30, about 3 to about 35, about 3 to about 40, about 3 to about 45, about 5 to about 10, about 5 to about 15, about 5 to about 20, about 5 to about 25, about 5 to about 30, about 5 to about 35, about 5 to about 40, about 5 to about 45, about 10 to about 15, about 10 to about 20, about 10 to about 25, about 10 to about 30, about 10 to about 35, about 10 to about 40, about 10 to about 45, about 15 to about 20, about 15 to about 25, about 15 to about 30, about 15 to about 35, about 15 to about 40, about 15 to about 45, about 20 to about 25, about 20 to about 30, about 20 to about 35, about 20 to about 40, about 20 to about 45, about 25 to about 30, about 25 to about 35, about 25 to about 40, about 25 to about 45, about 30 to about 35, about 30 to about 40, about 30 to about 45, about 35 to about 40, about 35 to about 45, about 40 to about 45, or about 45 to about 50 chemically modified nucleotides. In some embodiments, the chemically modified sgRNAs may comprise a total of about 1, about 3, about 5, about 10, about 15, about 20, about 25, about 30, about 35, about 40, about 45, or about 50 chemically modified nucleotides. In some embodiments, the chemically modified sgRNAs may comprise a total of at least about 1, about 3, about 5, about 10, about 15, about 20, about 25, about 30, about 35, about 40, about 45, or about 50 chemically modified nucleotides. In some embodiments, the chemically modified sgRNAs may comprise a total of at most about 3, about 5, about 10, about 15, about 20, about 25, about 30, about 35, about 40, about 45, or about 50 chemically modified nucleotides. In some embodiments, the chemically modified sgRNAs may comprise a total of about 50 to about 140 chemically modified nucleotides. In some embodiments, the chemically modified sgRNAs may comprise a total of about 50 to about 60, about 50 to about 70, about 50 to about 80, about 50 to about 90, about 50 to about 100, about 50 to about 110, about 50 to about 120, about 50 to about 130, about 50 to about 140, about 60 to about 70, about 60 to about 80, about 60 to about 90, about 60 to about 100, about 60 to about 110, about 60 to about 120, about 60 to about 130, about 60 to about 140, about 70 to about 80, about 70 to about 90, about 70 to about 100, about 70 to about 110, about 70 to about 120, about 70 to about 130, about 70 to about 140, about 80 to about 90, about 80 to about 100, about 80 to about 110, about 80 to about 120, about 80 to about 130, about 80 to about 140, about 90 to about 100, about 90 to about 110, about 90 to about 120, about 90 to about 130, about 90 to about 140, about 100 to about 110, about 100 to about 120, about 100 to about 130, about 100 to about 140, about 110 to about 120, about 110 to about 130, about 110 to about 140, about 120 to about 130, about 120 to about 140, or about 130 to about 140 chemically modified nucleotides. In some embodiments, the chemically modified sgRNAs may comprise a total of about 50, about 60, about 70, about 80, about 90, about 100, about 110, about 120, about 130, or about 140 chemically modified nucleotides. In some embodiments, the chemically modified sgRNAs may comprise a total of at least about 50, about 60, about 70, about 80, about 90, about 100, about 110, about 120, or about 130 chemically modified nucleotides. In some embodiments, the chemically modified sgRNAs may comprise a total of at most about 60, about 70, about 80, about 90, about 100, about 110, about 120, about 130, or about 140 chemically modified nucleotides. In one embodiment, the chemically modified sgRNAs may comprise a total of 54 chemically modified nucleotides. In another embodiment, the chemically modified sgRNAs may comprise a total of 62 chemically modified nucleotides.

In some embodiments, the chemically modified sgRNAs may comprise about 1% to about 100% chemically modified nucleotides. In some embodiments, the chemically modified sgRNAs may comprise about 1% to about 10%, about 1% to about 20%, about 1% to about 30%, about 1% to about 40%, about 1% to about 50%, about 1% to about 60%, about 1% to about 70%, about 1% to about 80%, about 1% to about 90%, about 1% to about 95%, about 1% to about 100%, about 10% to about 20%, about 10% to about 30%, about 10% to about 40%, about 10% to about 50%, about 10% to about 60%, about 10% to about 70%, about 10% to about 80%, about 10% to about 90%, about 10% to about 95% to about 10% to about 100%, about 20% to about 30%, about 20% to about 40%, about 20% to about 50%, about 20% to about 60%, about 20% to about 70%, about 20% to about 80%, about 20% to about 90%, about 20% to about 95%, about 20% to about 100%, about 30% to about 40%, about 30% to about 50%, about 30% to about 60%, about 30% to about 70%, about 30% to about 80%, about 30% to about 90%, about 30% to about 95%, about 30% to about 100%, about 40% to about 50%, about 40% to about 60%, about 40% to about 70%, about 40% to about 80%, about 40% to about 90%, about 40% to about 95%, about 40% to about 100%, about 50% to about 60%, about 50% to about 70%, about 50% to about 80%, about 50% to about 90%, about 50% to about 95%, about 50% to about 100%, about 60% to about 70%, about 60% to about 80%, about 60% to about 90%, about 60% to about 95%, about 60% to about 100%, about 70% to about 80%, about 70% to about 90%, about 70% to about 95%, about 70% to about 100%, about 80% to about 90%, about 80% to about 95%, about 80% to about 100%, about 90% to about 95%, about 90% to about 100%, or about 95% to about 100% chemically modified nucleotides. In some embodiments, the chemically modified sgRNAs may comprise about 1%, about 10%, about 20%, about 30%, about 40%, about 50%, about 60%, about 70%, about 80%, about 90%, about 95%, or about 100% chemically modified nucleotides. In some embodiments, the chemically modified sgRNAs may comprise at least about 1%, about 10%, about 20%, about 30%, about 40%, about 50%, about 60%, about 70%, about 80%, about 90%, or about 95% chemically modified nucleotides. In some embodiments, the chemically modified sgRNAs may comprise at most about 10%, about 20%, about 30%, about 40%, about 50%, about 60%, about 70%, about 80%, about 90%, about 95%, or about 100% chemically modified nucleotides.

In some embodiments, the chemically modified sgRNAs may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 in the 5'-3' direction in the sgRNA sequence.

In some embodiments, the chemically modified sgRNAs may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, or 149 base pairs from the 5' end of the sgRNA sequence.

In some embodiments, the chemically modified sgRNAs may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, or 149 base pairs from the 3' end of the sgRNA sequence.

In some embodiments, the chemically modified gRNAs or sgRNAs may have one or more chemical modifications in the spacer or protospacer region, i.e., the target sequence. In some embodiments, the chemically modified gRNAs or sgRNAs may comprise a spacer sequence of from 10 to 30 base pairs in length. In some embodiments, the chemically modified gRNAs or sgRNAs may comprise a spacer sequence of 10, 11, 12, 13, 14, 15, 16, 17, 18, 19, 20, 21, 22, 23, 24, 25, 26, 27, 28, 29, or 30 base pairs in length. In some embodiments, the chemically modified gRNAs or sgRNAs may comprise a spacer sequence of about 10 to about 30 base pairs in length. In some embodiments, the chemically modified gRNAs or sgRNAs may comprise a spacer sequence of about 10 to about 15, about 10 to about 20, about 10 to about 25, about 10 to about 30, about 15 to about 20, about 15 to about 25, about 15 to about 30, about 20 to about 25, about 20 to about 30, or about 25 to about 30 base pairs in length. In some embodiments, the chemically modified gRNAs or sgRNAs may comprise a spacer sequence of about 10, about 15, about 20, about 25, or about 30 base pairs in length. In some embodiments, the chemically modified gRNAs or sgRNAs may comprise a spacer sequence of at least about 10, about 15, about 20, or about 25 base pairs in length. In some embodiments, the chemically modified gRNAs or sgRNAs may comprise a spacer sequence of at most about 15, about 20, about 25, or about 30 base pairs in length. In one embodiment, the chemically modified gRNAs or sgRNAs may comprise a spacer sequence of 18 base pairs in length. In another embodiment, the chemically modified gRNAs or sgRNAs may comprise a spacer sequence of 22 base pairs in length. In a preferred embodiment, the chemically modified gRNAs or sgRNAs may comprise a spacer sequence of 20 base pairs in length.

In some embodiments, the spacer sequence may comprise a total of from 1 to 30 chemically modified nucleotides. In some embodiments, the spacer region may comprise a total of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 chemically modified nucleotides. In some embodiments, the spacer sequence may comprise a total of about 1 to about 10 chemically modified nucleotides. In some embodiments, the spacer sequence may comprise a total of about 1 to about 2, about 1 to about 3, about 1 to about 4, about 1 to about 5, about 1 to about 6, about 1 to about 7, about 1 to about 8, about 1 to about 9, about 1 to about 10, about 2 to about 3, about 2 to about 4, about 2 to about 5, about 2 to about 6, about 2 to about 7, about 2 to about 8, about 2 to about 9, about 2 to about 10, about 3 to about 4, about 3 to about 5, about 3 to about 6, about 3 to about 7, about 3 to about 8, about 3 to about 9, about 3 to about 10, about 4 to about 5, about 4 to about 6, about 4 to about 7, about 4 to about 8, about 4 to about 9, about 4 to about 10, about 5 to about 6, about 5 to about 7, about 5 to about 8, about 5 to about 9, about 5 to about 10, about 6 to about 7, about 6 to about 8, about 6 to about 9, about 6 to about 10, about 7 to about 8, about 7 to about 9, about 7 to about 10, about 8 to about 9, about 8 to about 10, or about 9 to about 10 chemically modified nucleotides. In some embodiments, the spacer sequence may comprise a total of about 1, about 2, about 3, about 4, about 5, about 6, about 7, about 8, about 9, or about 10 chemically modified nucleotides. In some embodiments, the spacer sequence may comprise a total of at least about 1, about 2, about 3, about 4, about 5, about 6, about 7, about 8, or about 9 chemically modified nucleotides. In some embodiments, the spacer sequence may comprise a total of at most about 2, about 3, about 4, about 5, about 6, about 7, about 8, about 9, or about 10 chemically modified nucleotides. In some embodiments, the spacer sequence may comprise a total of about 10 to about 30 chemically modified nucleotides. In some embodiments, the spacer sequence may comprise a total of about 10 to about 15, about 10 to about 20, about 10 to about 25, about 10 to about 30, about 15 to about 20, about 15 to about 25, about 15 to about 30, about 20 to about 25, about 20 to about 30, or about 25 to about 30 chemically modified nucleotides. In some embodiments, the spacer sequence may comprise a total of about 10, about 15, about 20, about 25, or about 30 chemically modified nucleotides. In some embodiments, the spacer sequence may comprise a total of at least about 10, about 15, about 20, or about 25 chemically modified nucleotides. In some embodiments, the spacer sequence may comprise a total of at most about 15, about 20, about 25, or about 30 chemically modified nucleotides. In one embodiment, the spacer sequence may comprise a total of 3 chemically modified nucleotides. In another embodiment, the spacer sequence may comprise a total of 5 chemically modified nucleotides.

In some embodiments, the spacer sequence may comprise from 1% to 100% chemically modified nucleotides. In some embodiments, the spacer sequence may comprise about 1% to about 100% chemically modified nucleotides. In some embodiments, the spacer sequence may comprise about 1% to about 10%, about 1% to about 20%, about 1% to about 30%, about 1% to about 40%, about 1% to about 50%, about 1% to about 60%, about 1% to about 70%, about 1% to about 80%, about 1% to about 90%, about 1% to about 95%, about 1% to about 100%, about 10% to about 20%, about 10% to about 30%, about 10% to about 40%, about 10% to about 50%, about 10% to about 60%, about 10% to about 70%, about 10% to about 80%, about 10% to about 90%, about 10% to about 95%, about 10% to about 100%, about 20% to about 30%, about 20% to about 40%, about 20% to about 50%, about 20% to about 60%, about 20% to about 70%, about 20% to about 80%, about 20% to about 90%, about 20% to about 95%, about 20% to about 100%, about 30% to about 40%, about 30% to about 50%, about 30% to about 60%, about 30% to about 70%, about 30% to about 80%, about 30% to about 90%, about 30% to about 95%, about 30% to about 100%, about 40% to about 50%, about 40% to about 60%, about 40% to about 70%, about 40% to about 80%, about 40% to about 90%, about 40% to about 95%, about 40% to about 100%, about 50% to about 60%, about 50% to about 70%, about 50% to about 80%, about 50% to about 90%, about 50% to about 95%, about 50% to about 100%, about 60% to about 70%, about 60% to about 80%, about 60% to about 90%, about 60% to about 95%, about 60% to about 100%, about 70% to about 80%, about 70% to about 90%, about 70% to about 95%, about 70% to about 100%, about 80% to about 90%, about 80% to about 95%, about 80% to about 100%, about 90% to about 95%, about 90% to about 100%, or about 95% to about 100% chemically modified nucleotides. In some embodiments, the spacer sequence may comprise about 1%, about 10%, about 20%, about 30%, about 40%, about 50%, about 60%, about 70%, about 80%, about 90%, about 95%, or about 100% chemically modified nucleotides. In some embodiments, the spacer sequence may comprise at least about 1%, about 10%, about 20%, about 30%, about 40%, about 50%, about 60%, about 70%, about 80%, about 90%, or about 95% chemically modified nucleotides. In some embodiments, the spacer sequence may comprise at most about 10%, about 20%, about 30%, about 40%, about 50%, about 6000, about 70%, about 80%, about 90%, about 95%, or about 100% chemically modified nucleotides.

In some embodiments, the chemically modified spacer sequence may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 in the 5'-3' direction in the spacer sequence.

In some embodiments, the chemically modified spacer region may have chemically modified nucleotide on one or more of the positions which are 1, 2, 3, 4, 5, 6, 7, 8, 9, 10, 11, 12, 13, 14, 15, 16, 17, 18, 19, 20, 21, 22, 23, 24, 25, 26, 27, 28, or 29 base pairs from the 5' end of the spacer sequence.

In some embodiments, the chemically modified spacer region may have chemically modified nucleotide on one or more the positions which are 1, 2, 3, 4, 5, 6, 7, 8, 9, 10, 11, 12, 13, 14, 15, 16, 17, 18, 19, 20, 21, 22, 23, 24, 25, 26, 27, 28, or 29 base pairs from the 3' end of the spacer sequence.

In some embodiments, the chemically modified gRNAs or sgRNAs may have one or more chemical modifications in the tracrRNA sequence. In some embodiments, the chemically modified gRNAs or sgRNAs may comprise a tracrRNA sequence of from 30 to 100 base pairs in length. In some embodiments, the chemically modified gRNAs or sgRNAs may comprise a tracrRNA sequence of 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, or 130base pairs in length. In some embodiments, the chemically modified gRNAs or sgRNAs may comprise a tracrRNA sequence of from about 30 to about 130 base pairs in length. In some embodiments, the chemically modified gRNAs or sgRNAs may comprise a tracrRNA sequence of from about 30 to about 40, about 30 to about 50, about 30 to about 60, about 30 to about 70, about 30 to about 75, about 30 to about 80, about 30 to about 90, about 30 to about 100, about 30 to about 110, about 30 to about 120, about 30 to about 130, about 40 to about 50, about 40 to about 60, about 40 to about 70, about 40 to about 75, about 40 to about 80, about 40 to about 90, about 40 to about 100, about 40 to about 110, about 40 to about 120, about 40 to about 130, about 50 to about 60, about 50 to about 70, about 50 to about 75, about 50 to about 80, about 50 to about 90, about 50 to about 100, about 50 to about 110, about 50 to about 120, about 50 to about 130, about 60 to about 70, about 60 to about 75, about 60 to about 80, about 60 to about 90, about 60 to about 100, about 60 to about 110, about 60 to about 120, about 60 to about 130, about 70 to about 75, about 70 to about 80, about 70 to about 90, about 70 to about 100, about 70 to about 110, about 70 to about 120, about 70 to about 130, about 75 to about 80, about 75 to about 90, about 75 to about 100, about 75 to about 110, about 75 to about 120, about 75 to about 130, about 80 to about 90, about 80 to about 100, about 80 to about 110, about 80 to about 120, about 80 to about 130, about 90 to about 100, about 90 to about 110, about 90 to about 120, about 90 to about 130, about 100 to about 110, about 100 to about 120, about 100 to about 130, about 110 to about 120, about 110 to about 130, or about 120 to about 130 base pairs in length. In some embodiments, the chemically modified gRNAs or sgRNAs may comprise a tracrRNA sequence of from about 30, about 40, about 50, about 60, about 70, about 75, about 80, about 90, about 100, about 110, about 120, or about 130 base pairs in length. In some embodiments, the chemically modified gRNAs or sgRNAs may comprise a tracrRNA sequence of from at least about 30, about 40, about 50, about 60, about 70, about 75, about 80, about 90, about 100, about 110, or about 120 base pairs in length. In some embodiments, the chemically modified gRNAs or sgRNAs may comprise a tracrRNA sequence of from at most about 40, about 50, about 60, about 70, about 75, about 80, about 90, about 100, about 110, about 120, or about 130 base pairs in length. In some embodiments, the chemically modified gRNAs or sgRNAs may comprise a tracrRNA sequence of 70 base pairs in length. In some embodiments, the chemically modified gRNAs or sgRNAs may comprise a tracrRNA sequence of 73 base pairs in length. In some embodiments, the chemically modified gRNAs or sgRNAs may comprise a tracrRNA sequence of 68 base pairs in length. In some embodiments, the chemically modified gRNAs or sgRNAs may comprise a tracrRNA sequence of 71 base pairs in length.

In some embodiments, the tracrRNA sequence may comprise a total of from 1 to 130 chemically modified nucleotides. In some embodiments, the chemically modified gRNAs or sgRNAs may comprise a tracrRNA sequence of from 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, or 130 chemically modified nucleotides. In some embodiments, the tracrRNA sequence may comprise a total of from about 1 to about 10 chemically modified nucleotides. In some embodiments, the tracrRNA sequence may comprise a total of from about 1 to about 2, about 1 to about 3, about 1 to about 4, about 1 to about 5, about 1 to about 6, about 1 to about 7, about 1 to about 8, about 1 to about 9, about 1 to about 10, about 2 to about 3, about 2 to about 4, about 2 to about 5, about 2 to about 6, about 2 to about 7, about 2 to about 8, about 2 to about 9, about 2 to about 10, about 3 to about 4, about 3 to about 5, about 3 to about 6, about 3 to about 7, about 3 to about 8, about 3 to about 9, about 3 to about 10, about 4 to about 5, about 4 to about 6, about 4 to about 7, about 4 to about 8, about 4 to about 9, about 4 to about 10, about 5 to about 6, about 5 to about 7, about 5 to about 8, about 5 to about 9, about 5 to about 10, about 6 to about 7, about 6 to about 8, about 6 to about 9, about 6 to about 10, about 7 to about 8, about 7 to about 9, about 7 to about 10, about 8 to about 9, about 8 to about 10, or about 9 to about 10 chemically modified nucleotides. In some embodiments, the tracrRNA sequence may comprise a total of from about 1, about 2, about 3, about 4, about 5, about 6, about 7, about 8, about 9, or about 10 chemically modified nucleotides. In some embodiments, the tracrRNA sequence may comprise a total of from at least about 1, about 2, about 3, about 4, about 5, about 6, about 7, about 8, or about 9 chemically modified nucleotides. In some embodiments, the tracrRNA sequence may comprise a total of from at most about 2, about 3, about 4, about 5, about 6, about 7, about 8, about 9, or about 10 chemically modified nucleotides. In some embodiments, the tracrRNA sequence may comprise a total of from about 10 to about 30 chemically modified nucleotides.

In some embodiments, the tracrRNA sequence may comprise a total of from about 10 to about 15, about 10 to about 20, about 10 to about 25, about 10 to about 30, about 15 to about 20, about 15 to about 25, about 15 to about 30, about 20 to about 25, about 20 to about 30, or about 25 to about 30 chemically modified nucleotides. In some embodiments, the tracrRNA sequence may comprise a total of from about 10, about 15, about 20, about 25, or about 30 chemically modified nucleotides. In some embodiments, the tracrRNA sequence may comprise a total of from at least about 10, about 15, about 20, or about 25 chemically modified nucleotides. In some embodiments, the spacer region may comprise a total of at most about 15, about 20, about 25, or about 30 chemically modified nucleotides. In some embodiments, the tracrRNA sequence may comprise a total of from about 30 to about 130 chemically modified nucleotides. In some embodiments, the tracrRNA sequence may comprise a total of from about 30 to about 40, about 30 to about 50, about 30 to about 60, about 30 to about 70, about 30 to about 75, about 30 to about 80, about 30 to about 90, about 30 to about 100, about 30 to about 110, about 30 to about 120, about 30 to about 130, about 40 to about 50, about 40 to about 60, about 40 to about 70, about 40 to about 75, about 40 to about 80, about 40 to about 90, about 40 to about 100, about 40 to about 110, about 40 to about 120, about 40 to about 130, about 50 to about 60, about 50 to about 70, about 50 to about 75, about 50 to about 80, about 50 to about 90, about 50 to about 100, about 50 to about 110, about 50 to about 120, about 50 to about 130, about 60 to about 70, about 60 to about 75, about 60 to about 80, about 60 to about 90, about 60 to about 100, about 60 to about 110, about 60 to about 120, about 60 to about 130, about 70 to about 75, about 70 to about 80, about 70 to about 90, about 70 to about 100, about 70 to about 110, about 70 to about 120, about 70 to about 130, about 75 to about 80, about 75 to about 90, about 75 to about 100, about 75 to about 110, about 75 to about 120, about 75 to about 130, about 80 to about 90, about 80 to about 100, about 80 to about 110, about 80 to about 120, about 80 to about 130, about 90 to about 100, about 90 to about 110, about 90 to about 120, about 90 to about 130, about 100 to about 110, about 100 to about 120, about 100 to about 130, about 110 to about 120, about 110 to about 130, or about 120 to about 130 chemically modified nucleotides. In some embodiments, the tracrRNA sequence may comprise a total of from about 30, about 40, about 50, about 60, about 70, about 75, about 80, about 90, about 100, about 110, about 120, or about 130 chemically modified nucleotides. In some embodiments, the tracrRNA sequence may comprise a total of from at least about 30, about 40, about 50, about 60, about 70, about 75, about 80, about 90, about 100, about 110, or about 120 chemically modified nucleotides.

In some embodiments, the tracrRNA sequence may comprise a total of from at most about 40, about 50, about 60, about 70, about 75, about 80, about 90, about 100, about 110, about 120, or about 130 chemically modified nucleotides. In one embodiment, the tracrRNA sequence may comprise a total of 51 chemically modified nucleotides. In another embodiment, the tracrRNA sequence may comprise a total of 59 chemically modified nucleotides.

In some embodiments, the tracrRNA sequence may comprise from 1% to 100% chemically modified nucleotides. In some embodiments, the tracrRNA sequence may comprise about 1% to about 100% chemically modified nucleotides. In some embodiments, the tracrRNA sequence may comprise about 1% to about 10%, about 1% to about 20%, about 1% to about 30%, about 1% to about 40%, about 1% to about 50%, about 1% to about 60%, about 1% to about 70%, about 1% to about 80%, about 1% to about 90%, about 1% to about 95%, about 1% to about 100%, about 10% to about 20%, about 10% to about 30%, about 10% to about 40%, about 10% to about 50%, about 10% to about 60%, about 10% to about 70%, about 10% to about 80%, about 10% to about 90%, about 10% to about 95%, about 10% to about 100%, about 20% to about 30%, about 20% to about 40%, about 20% to about 50%, about 20% to about 60%, about 20% to about 70%, about 20% to about 80%, about 20% to about 90%, about 20% to about 95%, about 20% to about 100%, about 30% to about 40%, about 30% to about 50%, about 30% to about 60%, about 30% to about 70%, about 30% to about 80%, about 30% to about 90%, about 30% to about 95%, about 30% to about 100%, about 40% to about 50%, about 40% to about 60%, about 40% to about 70%, about 40% to about 80%, about 40% to about 90%, about 40% to about 95%, about 40% to about 100%, about 50% to about 60%, about 50% to about 70%, about 50% to about 80%, about 50% to about 90%, about 50% to about 95%, about 50% to about 100%, about 60% to about 70%, about 60% to about 80%, about 60% to about 90%, about 60% to about 95%, about 60% to about 100%, about 70% to about 80%, about 70% to about 90%, about 70% to about 95%, about 70% to about 100%, about 80% to about 90%, about 80% to about 95%, about 80% to about 100%, about 90% to about 95%, about 90% to about 100%, or about 95% to about 100% chemically modified nucleotides. In some embodiments, the tracrRNA sequence may comprise about 1%, about 10%, about 20%, about 30%, about 40%, about 50%, about 60%, about 70%, about 80%, about 90%, about 95%, or about 100% chemically modified nucleotides. In some embodiments, the tracrRNA sequence may comprise at least about 1%, about 10%, about 20%, about 30%, about 40%, about 50%, about 60%, about 70%, about 80%, about 90%, or about 95% chemically modified nucleotides. In some embodiments, the tracrRNA sequence may comprise at most about 10%, about 20%, about 30%, about 40%, about 50%, about 60%, about 70%, about 80%, about 90%, about 95%, or about 100% chemically modified nucleotides.

In some embodiments, the chemically modified tracrRNA sequence may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, or 130 in the 5'-3' direction in the tracrRNA sequence.

In some embodiments, the chemically modified tracr region may have chemically modified nucleotide on one or more of the positions which are 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, or 129 base pairs from the 5' end of the tracrRNA sequence.

In some embodiments, the chemically modified tracr region may have chemically modified nucleotide on one or more the positions which are 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, or 129 base pairs from the 3' end of the tracrRNA sequence.

In some embodiments, the chemically modified gRNAs may have one or more chemical modifications in the 5' end of the gRNA sequence. In some embodiments, the chemically modified gRNAs may comprise one or more chemically modified nucleotides in the 5' end of the gRNA sequence. In some embodiments, the chemically modified gRNAs may have one or more chemical modifications in the 3' end of the gRNA sequence. In some embodiments, the chemically modified gRNAs may comprise one or more chemically modified nucleotides in the 3' end of the gRNA sequence.

In some embodiments, the chemically modified gRNAs may comprise a crRNA. In some embodiments, the crRNA may comprise one or more chemically modified nucleotides. In some embodiments, the chemically modified crRNA may be of from 30 to 50 base pairs in length. In some embodiments, the chemically modified crRNA may be of 30, 31, 32, 33, 34, 35, 36, 37, 38, 39, 40, 41, 42, 43, 44, 45, 46, 47, 48, 49, or 50 base pairs in length. In some embodiments, the chemically modified crRNA may be of from about 30 to about 50 base pairs in length. In some embodiments, the chemically modified crRNA may be of from about 30 to about 32, about 30 to about 34, about 30 to about 36, about 30 to about 38, about 30 to about 40, about 30 to about 42, about 30 to about 44, about 30 to about 46, about 30 to about 48, about 30 to about 50, about 32 to about 34, about 32 to about 36, about 32 to about 38, about 32 to about 40, about 32 to about 42, about 32 to about 44, about 32 to about 46, about 32 to about 48, about 32 to about 50, about 34 to about 36, about 34 to about 38, about 34 to about 40, about 34 to about 42, about 34 to about 44, about 34 to about 46, about 34 to about 48, about 34 to about 50, about 36 to about 38, about 36 to about 40, about 36 to about 42, about 36 to about 44, about 36 to about 46, about 36 to about 48, about 36 to about 50, about 38 to about 40, about 38 to about 42, about 38 to about 44, about 38 to about 46, about 38 to about 48, about 38 to about 50, about 40 to about 42, about 40 to about 44, about 40 to about 46, about 40 to about 48, about 40 to about 50, about 42 to about 44, about 42 to about 46, about 42 to about 48, about 42 to about 50, about 44 to about 46, about 44 to about 48, about 44 to about 50, about 46 to about 48, about 46 to about 50, or about 48 to about 50 base pairs in length. In some embodiments, the chemically modified crRNA may be of from about 30, about 32, about 34, about 36, about 38, about 40, about 42, about 44, about 46, about 48, or about 50 base pairs in length. In some embodiments, the chemically modified crRNA may be of from at least about 30, about 32, about 34, about 36, about 38, about 40, about 42, about 44, about 46, or about 48 base pairs in length. In some embodiments, the chemically modified crRNA may be of from at most about 32, about 34, about 36, about 38, about 40, about 42, about 44, about 46, about 48, or about 50 base pairs in length.

In some embodiments, the crRNA may comprise a total of from 1 to 50 chemically modified nucleotides. In some embodiments, the chemically modified crRNA may comprise a total of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 chemically modified nucleotides. In some embodiments, the chemically modified crRNA may comprise a total of about 1 to about 10 chemically modified nucleotides. In some embodiments, the chemically modified crRNA may comprise a total of about 1 to about 2, about 1 to about 3, about 1 to about 4, about 1 to about 5, about 1 to about 6, about 1 to about 7, about 1 to about 8, about 1 to about 9, about 1 to about 10, about 2 to about 3, about 2 to about 4, about 2 to about 5, about 2 to about 6, about 2 to about 7, about 2 to about 8, about 2 to about 9, about 2 to about 10, about 3 to about 4, about 3 to about 5, about 3 to about 6, about 3 to about 7, about 3 to about 8, about 3 to about 9, about 3 to about 10, about 4 to about 5, about 4 to about 6, about 4 to about 7, about 4 to about 8, about 4 to about 9, about 4 to about 10, about 5 to about 6, about 5 to about 7, about 5 to about 8, about 5 to about 9, about 5 to about 10, about 6 to about 7, about 6 to about 8, about 6 to about 9, about 6 to about 10, about 7 to about 8, about 7 to about 9, about 7 to about 10, about 8 to about 9, about 8 to about 10, or about 9 to about 10 chemically modified nucleotides. In some embodiments, the chemically modified crRNA may comprise a total of about 1, about 2, about 3, about 4, about 5, about 6, about 7, about 8, about 9, or about 10 chemically modified nucleotides. In some embodiments, the chemically modified crRNA may comprise a total of at least about 1, about 2, about 3, about 4, about 5, about 6, about 7, about 8, or about 9 chemically modified nucleotides. In some embodiments, the chemically modified crRNA may comprise a total of at most about 2, about 3, about 4, about 5, about 6, about 7, about 8, about 9, or about 10 chemically modified nucleotides. In some embodiments, the chemically modified crRNA may comprise a total of about 10 to about 30 chemically modified nucleotides. In some embodiments, the chemically modified crRNA may comprise a total of about 10 to about 15, about 10 to about 20, about 10 to about 25, about 10 to about 30, about 15 to about 20, about 15 to about 25, about 15 to about 30, about 20 to about 25, about 20 to about 30, or about 25 to about 30 chemically modified nucleotides. In some embodiments, the chemically modified crRNA may comprise a total of about 10, about 15, about 20, about 25, or about 30 chemically modified nucleotides. In some embodiments, the chemically modified crRNA may comprise a total of at least about 10, about 15, about 20, or about 25 chemically modified nucleotides. In some embodiments, the chemically modified crRNA may comprise a total of at most about 15, about 20, about 25, or about 30 chemically modified nucleotides.

In some embodiments, the chemically modified crRNA may comprise a total of from about 30 to about 50 chemically modified nucleotides. In some embodiments, the chemically modified crRNA may comprise a total of from about 30 to about 32, about 30 to about 34, about 30 to about 36, about 30 to about 38, about 30 to about 40, about 30 to about 42, about 30 to about 44, about 30 to about 46, about 30 to about 48, about 30 to about 50, about 32 to about 34, about 32 to about 36, about 32 to about 38, about 32 to about 40, about 32 to about 42, about 32 to about 44, about 32 to about 46, about 32 to about 48, about 32 to about 50, about 34 to about 36, about 34 to about 38, about 34 to about 40, about 34 to about 42, about 34 to about 44, about 34 to about 46, about 34 to about 48, about 34 to about 50, about 36 to about 38, about 36 to about 40, about 36 to about 42, about 36 to about 44, about 36 to about 46, about 36 to about 48, about 36 to about 50, about 38 to about 40, about 38 to about 42, about 38 to about 44, about 38 to about 46, about 38 to about 48, about 38 to about 50, about 40 to about 42, about 40 to about 44, about 40 to about 46, about 40 to about 48, about 40 to about 50, about 42 to about 44, about 42 to about 46, about 42 to about 48, about 42 to about 50, about 44 to about 46, about 44 to about 48, about 44 to about 50, about 46 to about 48, about 46 to about 50, or about 48 to about 50 chemically modified nucleotides. In some embodiments, the chemically modified crRNA may comprise a total of from about 30, about 32, about 34, about 36, about 38, about 40, about 42, about 44, about 46, about 48, or about 50 chemically modified nucleotides. In some embodiments, the chemically modified crRNA may comprise a total of from at least about 30, about 32, about 34, about 36, about 38, about 40, about 42, about 44, about 46, or about 48 chemically modified nucleotides. In some embodiments, the chemically modified crRNA may comprise a total of from at most about 32, about 34, about 36, about 38, about 40, about 42, about 44, about 46, about 48, or about 50 chemically modified nucleotides.

In some embodiments, the crRNA may comprise from 1% to 100% chemically modified nucleotides. In some embodiments, the crRNA may comprise about 1% to about 100% chemically modified nucleotides. In some embodiments, the crRNA may comprise about 1% to about 10%, about 1% to about 20%, about 1% to about 30%, about 1% to about 40%, about 1% to about 50%, about 1% to about 60%, about 1% to about 70%, about 1% to about 80%, about 1% to about 90%, about 1% to about 95%, about 1% to about 100%, about 10% to about 20%, about 10% to about 30%, about 10% to about 40%, about 10% to about 50%, about 10% to about 60%, about 10% to about 70%, about 10% to about 80%, about 10% to about 90%, about 10% to about 95%, about 10% to about 100%, about 20% to about 30%, about 20% to about 40%, about 20% to about 50%, about 20% to about 60%, about 20% to about 70%, about 20% to about 80%, about 20% to about 90%, about 20% to about 95%, about 20% to about 100%, about 30% to about 40%, about 30% to about 50%, about 30% to about 60%, about 30% to about 70%, about 30% to about 80%, about 30% to about 90%, about 30% to about 95%, about 30% to about 100%, about 40% to about 50%, about 40% to about 60%, about 40% to about 70%, about 40% to about 80%, about 40% to about 90%, about 40% to about 95%, about 40% to about 100%, about 50% to about 60%, about 50% to about 70%, about 50% to about 80%, about 50% to about 90%, about 50% to about 95%, about 50% to about 100%, about 60% to about 70%, about 60% to about 80%, about 60% to about 90%, about 60% to about 95%, about 60% to about 100%, about 70% to about 80%, about 70% to about 90%, about 70% to about 95%, about 70% to about 100%, about 80% to about 90%, about 80% to about 95%, about 80% to about 100%, about 90% to about 95%, about 90% to about 100%, or about 95% to about 100% chemically modified nucleotides. In some embodiments, the crRNA may comprise about 1%, about 10%, about 20%, about 30%, about 40%, about 50%, about 60%, about 70%, about 80%, about 90%, about 95%, or about 100% chemically modified nucleotides. In some embodiments, the crRNA may comprise at least about 1%, about 10%, about 20%, about 30%, about 40%, about 50%, about 60%, about 70%, about 80%, about 90%, or about 95% chemically modified nucleotides. In some embodiments, the crRNA may comprise at most about 10%, about 20%, about 30%, about 40%, about 50%, about 60%, about 70%, about 80%, about 90%, about 95%, or about 100% chemically modified nucleotides.

In some embodiments, the chemically modified crRNA may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 in the 5'-3' direction in the crRNA sequence.

In some embodiments, the chemically modified crRNA may have chemically modified nucleotide on one or more of the positions which are 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 base pairs from the 5' end of the crRNA sequence.

In some embodiments, the chemically modified crRNA may have chemically modified nucleotide on one or more of the positions which are 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 base pairs from the 3' end of the crRNA sequence.

In some embodiments, the chemically modified gRNAs may comprise a tracrRNA. In some embodiments, the tracrRNA may comprise one or more chemically modified nucleotides. In some embodiments, the chemically modified tracrRNA may comprise a total of from 50 to 130 base pairs in length. In some embodiments, the chemically modified tracrRNA may comprise a total of 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, or 130 base pairs in length. In some embodiments, the chemically modified tracrRNA may comprise a total of about 30 to about 130 base pairs in length. In some embodiments, the chemically modified tracrRNA may comprise a total of about 30 to about 40, about 30 to about 50, about 30 to about 60, about 30 to about 70, about 30 to about 75, about 30 to about 80, about 30 to about 90, about 30 to about 100, about 30 to about 110, about 30 to about 120, about 30 to about 130, about 40 to about 50, about 40 to about 60, about 40 to about 70, about 40 to about 75, about 40 to about 80, about 40 to about 90, about 40 to about 100, about 40 to about 110, about 40 to about 120, about 40 to about 130, about 50 to about 60, about 50 to about 70, about 50 to about 75, about 50 to about 80, about 50 to about 90, about 50 to about 100, about 50 to about 110, about 50 to about 120, about 50 to about 130, about 60 to about 70, about 60 to about 75, about 60 to about 80, about 60 to about 90, about 60 to about 100, about 60 to about 110, about 60 to about 120, about 60 to about 130, about 70 to about 75, about 70 to about 80, about 70 to about 90, about 70 to about 100, about 70 to about 110, about 70 to about 120, about 70 to about 130, about 75 to about 80, about 75 to about 90, about 75 to about 100, about 75 to about 110, about 75 to about 120, about 75 to about 130, about 80 to about 90, about 80 to about 100, about 80 to about 110, about 80 to about 120, about 80 to about 130, about 90 to about 100, about 90 to about 110, about 90 to about 120, about 90 to about 130, about 100 to about 110, about 100 to about 120, about 100 to about 130, about 110 to about 120, about 110 to about 130, or about 120 to about 130 base pairs in length. In some embodiments, the chemically modified tracrRNA may comprise a total of about 30, about 40, about 50, about 60, about 70, about 75, about 80, about 90, about 100, about 110, about 120, or about 130 base pairs in length. In some embodiments, the chemically modified tracrRNA may comprise a total of at least about 30, about 40, about 50, about 60, about 70, about 75, about 80, about 90, about 100, about 110, or about 120 base pairs in length. In some embodiments, the chemically modified tracrRNA may comprise a total of at most about 40, about 50, about 60, about 70, about 75, about 80, about 90, about 100, about 110, about 120, or about 130 base pairs in length.

In some embodiments, the chemically modified tracrRNA may comprise a total of from 1 to 130 chemically modified nucleotides. In some embodiments, the chemically modified tracrRNA may comprise a total of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, or 130 chemically modified nucleotides. In some embodiments, the chemically modified tracrRNA may comprise a total of about 1 to about 10 chemically modified nucleotides. In some embodiments, the chemically modified tracrRNA may comprise a total of about 1 to about 2, about 1 to about 3, about 1 to about 4, about 1 to about 5, about 1 to about 6, about 1 to about 7, about 1 to about 8, about 1 to about 9, about 1 to about 10, about 2 to about 3, about 2 to about 4, about 2 to about 5, about 2 to about 6, about 2 to about 7, about 2 to about 8, about 2 to about 9, about 2 to about 10, about 3 to about 4, about 3 to about 5, about 3 to about 6, about 3 to about 7, about 3 to about 8, about 3 to about 9, about 3 to about 10, about 4 to about 5, about 4 to about 6, about 4 to about 7, about 4 to about 8, about 4 to about 9, about 4 to about 10, about 5 to about 6, about 5 to about 7, about 5 to about 8, about 5 to about 9, about 5 to about 10, about 6 to about 7, about 6 to about 8, about 6 to about 9, about 6 to about 10, about 7 to about 8, about 7 to about 9, about 7 to about 10, about 8 to about 9, about 8 to about 10, or about 9 to about 10 chemically modified nucleotides. In some embodiments, the chemically modified tracrRNA may comprise a total of about 1, about 2, about 3, about 4, about 5, about 6, about 7, about 8, about 9, or about 10 chemically modified nucleotides. In some embodiments, the chemically modified tracrRNA may comprise a total of at least about 1, about 2, about 3, about 4, about 5, about 6, about 7, about 8, or about 9 chemically modified nucleotides. In some embodiments, the chemically modified tracrRNA may comprise a total of at most about 2, about 3, about 4, about 5, about 6, about 7, about 8, about 9, or about 10 chemically modified nucleotides. In some embodiments, the chemically modified tracrRNA may comprise a total of about 10 to about 30 chemically modified nucleotides. In some embodiments, the chemically modified tracrRNA may comprise a total of about 10 to about 15, about 10 to about 20, about 10 to about 25, about 10 to about 30, about 15 to about 20, about 15 to about 25, about 15 to about 30, about 20 to about 25, about 20 to about 30, or about 25 to about 30 chemically modified nucleotides. In some embodiments, the chemically modified tracrRNA may comprise a total of about 10, about 15, about 20, about 25, or about 30 chemically modified nucleotides. In some embodiments, the chemically modified tracrRNA may comprise a total of at least about 10, about 15, about 20, or about 25 chemically modified nucleotides. In some embodiments, the spacer region may comprise a total of at most about 15, about 20, about 25, or about 30 chemically modified nucleotides. In some embodiments, the chemically modified tracrRNA may comprise a total of about 30 to about 130 chemically modified nucleotides. In some embodiments, the chemically modified tracrRNA may comprise a total of about 30 to about 40, about 30 to about 50, about 30 to about 60, about 30 to about 70, about 30 to about 75, about 30 to about 80, about 30 to about 90, about 30 to about 100, about 30 to about 110, about 30 to about 120, about 30 to about 130, about 40 to about 50, about 40 to about 60, about 40 to about 70, about 40 to about 75, about 40 to about 80, about 40 to about 90, about 40 to about 100, about 40 to about 110, about 40 to about 120, about 40 to about 130, about 50 to about 60, about 50 to about 70, about 50 to about 75, about 50 to about 80, about 50 to about 90, about 50 to about 100, about 50 to about 110, about 50 to about 120, about 50 to about 130, about 60 to about 70, about 60 to about 75, about 60 to about 80, about 60 to about 90, about 60 to about 100, about 60 to about 110, about 60 to about 120, about 60 to about 130, about 70 to about 75, about 70 to about 80, about 70 to about 90, about 70 to about 100, about 70 to about 110, about 70 to about 120, about 70 to about 130, about 75 to about 80, about 75 to about 90, about 75 to about 100, about 75 to about 110, about 75 to about 120, about 75 to about 130, about 80 to about 90, about 80 to about 100, about 80 to about 110, about 80 to about 120, about 80 to about 130, about 90 to about 100, about 90 to about 110, about 90 to about 120, about 90 to about 130, about 100 to about 110, about 100 to about 120, about 100 to about 130, about 110 to about 120, about 110 to about 130, or about 120 to about 130 chemically modified nucleotides. In some embodiments, the chemically modified tracrRNA may comprise a total of about 30, about 40, about 50, about 60, about 70, about 75, about 80, about 90, about 100, about 110, about 120, or about 130 chemically modified nucleotides. In some embodiments, the chemically modified tracrRNA may comprise a total of at least about 30, about 40, about 50, about 60, about 70, about 75, about 80, about 90, about 100, about 110, or about 120 chemically modified nucleotides. In some embodiments, the chemically modified tracrRNA may comprise a total of at most about 40, about 50, about 60, about 70, about 75, about 80, about 90, about 100, about 110, about 120, or about 130 chemically modified nucleotides.

In some embodiments, the chemically modified tracrRNA may comprise about 1% to about 100% chemically modified nucleotides. In some embodiments, the chemically modified tracrRNA may comprise about 1% to about 10%, about 1% to about 20%, about 1% to about 30%, about 1% to about 40%, about 1% to about 50%, about 1% to about 60%, about 1% to about 70%, about 1% to about 80%, about 1% to about 90%, about 1% to about 95%, about 1% to about 100%, about 10% to about 20%, about 10% to about 30%, about 10% to about 40%, about 10% to about 50%, about 10% to about 60%, about 10% to about 70%, about 10% to about 80%, about 10% to about 90%, about 10% to about 95%, about 10% to about 100%, about 20% to about 30%, about 20% to about 40%, about 20% to about 50%, about 20% to about 60%, about 20% to about 70%, about 20% to about 80%, about 20% to about 90%, about 20% to about 95%, about 20% to about 100%, about 30% to about 40%, about 30% to about 50%, about 30% to about 60%, about 30% to about 70%, about 30% to about 80%, about 30% to about 90%, about 30% to about 95%, about 30% to about 100%, about 40% to about 50%, about 40% to about 60%, about 40% to about 70%, about 40% to about 80%, about 40% to about 90%, about 40% to about 95%, about 40% to about 100%, about 50% to about 60%, about 50% to about 70%, about 50% to about 80%, about 50% to about 90%, about 50% to about 95%, about 50% to about 100%, about 60% to about 70%, about 60% to about 80%, about 60% to about 90%, about 60% to about 95%, about 60% to about 100%, about 70% to about 80%, about 70% to about 90%, about 70% to about 95%, about 70% to about 100%, about 80% to about 90%, about 80% to about 95%, about 80% to about 100%, about 90% to about 95%, about 90% to about 100%, or about 95% to about 100% chemically modified nucleotides. In some embodiments, the chemically modified tracrRNA may comprise about 1%, about 10%, about 20%, about 30%, about 40%, about 50%, about 60%, about 70%, about 80%, about 90%, about 95%, or about 100% chemically modified nucleotides. In some embodiments, the chemically modified tracrRNA may comprise at least about 1%, about 10%, about 20%, about 30%, about 40%, about 50%, about 60%, about 70%, about 80%, about 90%, or about 95% chemically modified nucleotides. In some embodiments, the chemically modified tracrRNA may comprise at most about 10%, about 20%, about 30%, about 40%, about 50%, about 60%, about 70%, about 80%, about 90%, about 95%, or about 100% chemically modified nucleotides.

In some embodiments, the chemically modified tracrRNA may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, or 130 in the 5'-3' direction in the tracrRNA sequence.

In some embodiments, the chemically modified tracrRNA may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, or 129 base pairs from the 5' end of the tracrRNA sequence.

In some embodiments, the chemically modified tracrRNA may have chemically modified nucleotide on one or more of the positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, or 129 base pairs from the 3' end of the tracrRNA sequence.

In some embodiments, the chemically modified gRNA or sgRNA comprises phosphorothioate (PS) linkages at the 5' or 3' end of the gRNA sequence. In some embodiments, the chemically modified gRNA or sgRNA comprises 0, 1, 2, 3, 4, or 5 PS linkages at the 5' end of the gRNA or sgRNA sequence. In some embodiments, the chemically modified gRNA or sgRNA comprises 0, 1, 2, 3, 4, or 5 PS linkages at the 3' end of the gRNA or sgRNA sequence. In some embodiments, the chemically modified gRNA or sgRNA comprises 0, 1, 2, 3, 4, or 5 PS linkages, or any combinations thereof at each of 5' and 3' end of the gRNA or sgRNA sequence. In some embodiments, the chemically modified gRNA or sgRNA comprises 0, 1, 2 or 3 PS linkages, or any combinations thereof at each of 5' and 3' end of the gRNA or sgRNA sequence. In some embodiments, the chemically modified gRNA or sgRNA comprises 1 PS linkage at each of 5' and 3' end of the gRNA or sgRNA sequence. In some embodiments, the chemically modified gRNA or sgRNA comprises 2 PS linkages at each of 5' and 3' end of the gRNA or sgRNA sequence. In some embodiments, the chemically modified gRNA or sgRNA comprises 3 PS linkages at each of 5' and 3' end of the gRNA or sgRNA sequence. In some embodiments, the chemically modified gRNA or sgRNA comprises 4 PS linkages at each of 5' and 3' end of the gRNA or sgRNA sequence. In some embodiments, the chemically modified gRNA or sgRNA comprises 5 PS linkages at each of 5' and 3' end of the gRNA or sgRNA sequence. In some embodiments, the chemically modified gRNA or sgRNA comprises 3 PS linkages at the 5' end and 0 PS linkage (i.e., no modification) at the 3' end of the gRNA or sgRNA sequence.

In some embodiments, the chemically modified gRNA or sgRNA comprises 3 PS linkages at the 5' end and 1 PS linkage at the 3' end of the gRNA or sgRNA sequence. In some embodiments, the chemically modified gRNA or sgRNA comprises 3 PS linkages at the 5' end and 2 PS linkages at the 3' end of the gRNA or sgRNA sequence. In some embodiments, the chemically modified gRNA or sgRNA comprises 3 PS linkages at the 5' end and 4 PS linkages at the 3' end of the gRNA or sgRNA sequence. In some embodiments, the chemically modified gRNA or sgRNA comprises 3 PS linkages at the 5' end and 5 PS linkages at the 3' end of the gRNA or sgRNA sequence. In some embodiments, the chemically modified gRNA or sgRNA comprises 2 PS linkages at the 5' end and 0 PS linkage (i.e., no modification) at the 3' end of the gRNA or sgRNA sequence. In some embodiments, the chemically modified gRNA or sgRNA comprises 2 PS linkages at the 5' end and 1 PS linkage at the 3' end of the gRNA or sgRNA sequence. In some embodiments, the chemically modified gRNA or sgRNA comprises 2 PS linkages at the 5' end and 3 PS linkages at the 3' end of the gRNA or sgRNA sequence. In some embodiments, the chemically modified gRNA or sgRNA comprises 2 PS linkages at the 5' end and 4 PS linkages at the 3' end of the gRNA or sgRNA sequence. In some embodiments, the chemically modified gRNA or sgRNA comprises 2 PS linkages at the 5' end and 5 PS linkages at the 3' end of the gRNA or sgRNA sequence.

In some embodiments, the chemically modified gRNA or sgRNA comprises 2 and no more than 2 contiguous phosphorothioate (PS) linkages at the 5' end. In some embodiments, the chemically modified gRNA or sgRNA comprises 2 and no more than 2 contiguous phosphorothioate (PS) linkages at the 3' end. In some embodiments, the chemically modified gRNA or sgRNA comprises 3 contiguous phosphorothioate (PS) linkages at the 5' end. In some embodiments, the chemically modified gRNA or sgRNA comprises 3 contiguous phosphorothioate (PS) linkages at the 3' end. In some embodiments, the chemically modified gRNA or sgRNA comprises the sequence 5'-UsUsU-3' at the 3'end or at the 5' end, wherein U indicates a uridine and wherein s indicates a phosphorothioate (PS) linkage. In some embodiments, the chemically modified gRNA or sgRNA comprises 3 phosphorothioate (PS) linkages at the 5' end. In some embodiments, the chemically modified gRNA or sgRNA comprises 3 phosphorothioate (PS) linkages at the 3' end. In some embodiments, the chemically modified gRNA or sgRNA comprises the two phosphorothioate linkages at the 5' end, wherein the two phosphorothioate (PS) linkages are two contiguous phosphorothioate (PS) linkages at the first two nucleotide positions of the 5' end. In some embodiments, the chemically modified gRNA or sgRNA comprises the two phosphorothioate linkages at the 5' end, wherein the two phosphorothioate (PS) linkages are within the first 3-10 nucleotides of the 5' end. In some embodiments, the chemically modified gRNA or sgRNA comprises the two phosphorothioate (PS) linkages at the 3' end, wherein the two phosphorothioate (PS) linkages are two contiguous phosphorothioate (PS) linkages at the first two nucleotide positions of the 3' end. In some embodiments, the chemically modified gRNA or sgRNA comprises the two phosphorothioate (PS) linkages at the 3' end, wherein the two phosphorothioate (PS) linkages are within the first 3-10 nucleotides of the 3' end. In some embodiments, the chemically modified gRNA or sgRNA comprises the sequence 5'-UsUsUs-3' at the 3' end, wherein U indicates a uridine and s indicates a phosphorothioate (PS) linkage. In some embodiments, the chemically modified gRNA or sgRNA comprises the sequence 5'-UsUsU-3' at the 3'end, wherein U indicates a uridine and s indicates a phosphorothioate (PS) linkage.

In some embodiments, the chemically modified gRNA or sgRNA comprises PS linkages at the internal positions of the gRNA or sgRNA sequence. In some embodiments, the chemically modified gRNA or sgRNA comprises 1, 2, 3, 4, 5, 6, 7, 8, 9, or 10 PS linkages at the internal positions of the gRNA or sgRNA sequence. In some embodiments, the chemically modified gRNA or sgRNA comprises 1 PS linkage at the internal position of the gRNA or sgRNA sequence. In some embodiments, the chemically modified gRNA or sgRNA comprises 2 PS linkages at the internal positions of the gRNA or sgRNA sequence. In some embodiments, the chemically modified gRNA or sgRNA comprises 3 PS linkages at the internal positions of the gRNA or sgRNA sequence. In some embodiments, the chemically modified gRNA or sgRNA comprises 4 PS linkages at the internal positions of the gRNA or sgRNA sequence. In some embodiments, the chemically modified gRNA or sgRNA comprises 5 PS linkages at the internal positions of the gRNA or sgRNA sequence. In some embodiments, the chemically modified gRNA or sgRNA comprises 6 PS linkages at the internal positions of the gRNA or sgRNA sequence. In some embodiments, the chemically modified gRNA or sgRNA comprises 7 PS linkages at the internal positions of the gRNA or sgRNA sequence. In some embodiments, the chemically modified gRNA or sgRNA comprises 8 PS linkages at the internal positions of the gRNA or sgRNA sequence. In some embodiments, the chemically modified gRNA or sgRNA comprises 9 PS linkages at the internal positions of the gRNA or sgRNA sequence. In some embodiments, the chemically modified gRNA or sgRNA comprises 10 PS linkages at the internal positions of the gRNA or sgRNA sequence.

In some embodiments, the chemically modified gRNA or sgRNA comprises PS linkages at the 5' end, the 3' end, or at the internal positions, or any combination thereof, of the gRNA or sgRNA sequence. In some embodiments, the chemically modified gRNA or sgRNA comprises 0, 1, 2, 3, 4, 5, 6, 7, 8, 9, or 10 PS linkages at the 5'end, the 3' end, or at the internal positions, or any combination thereof, of the gRNA or sgRNA sequence.

In some embodiments, the chemically modified gRNA or sgRNA comprises 2 PS linkages at the 5' end, 3 PS linkages at the 3' end, and 0 PS linkage (i.e., no modification) at the internal position of the gRNA or sgRNA sequence. In some embodiments, the chemically modified gRNA or sgRNA comprises 2 PS linkages at the 5' end, 3 PS linkages at the 3' end, and 1 PS linkage at the internal position of the gRNA or sgRNA sequence. In some embodiments, the chemically modified gRNA or sgRNA comprises 2 PS linkages at the 5' end, 3 PS linkages at the 3' end, and 2 PS linkages at the internal positions of the gRNA or sgRNA sequence. In some embodiments, the chemically modified gRNA or sgRNA comprises 2 PS linkages at the 5' end, 3 PS linkages at the 3' end, and 3 PS linkages at the internal positions of the gRNA or sgRNA sequence. In some embodiments, the chemically modified gRNA or sgRNA comprises 2 PS linkages at the 5' end, 3 PS linkages at the 3' end, and 4 PS linkages at the internal positions of the gRNA or sgRNA sequence. In some embodiments, the chemically modified gRNA or sgRNA comprises 2 PS linkages at the 5' end, 3 PS linkages at the 3' end, and 5 PS linkages at the internal positions of the gRNA or sgRNA sequence. In some embodiments, the chemically modified gRNA or sgRNA comprises 2 PS linkages at the 5' end, 3 PS linkages at the 3' end, and 6 PS linkages at the internal positions of the gRNA or sgRNA sequence.

In some embodiments, the chemically modified gRNA or sgRNA comprises 3 PS linkages at the 5' end, 2 PS linkages at the 3' end, and 0 PS linkage (i.e., no modification) at the internal position of the gRNA or sgRNA sequence. In some embodiments, the chemically modified gRNA or sgRNA comprises 3 PS linkages at the 5' end, 2 PS linkages at the 3' end, and 1 PS linkage at the internal position of the gRNA or sgRNA sequence. In some embodiments, the chemically modified gRNA or sgRNA comprises 3 PS linkages at the 5' end, 2 PS linkages at the 3' end, and 2 PS linkages at the internal positions of the gRNA or sgRNA sequence. In some embodiments, the chemically modified gRNA or sgRNA comprises 3 PS linkages at the 5' end, 2 PS linkages at the 3' end, and 3 PS linkages at the internal positions of the gRNA or sgRNA sequence. In some embodiments, the chemically modified gRNA or sgRNA comprises 3 PS linkages at the 5' end, 2 PS linkages at the 3' end, and 4 PS linkages at the internal positions of the gRNA or sgRNA sequence. In some embodiments, the chemically modified gRNA or sgRNA comprises 3 PS linkages at the 5' end, 2 PS linkages at the 3' end, and 5 PS linkages at the internal positions of the gRNA or sgRNA sequence. In some embodiments, the chemically modified gRNA or sgRNA comprises 3 PS linkages at the 5' end, 2 PS linkages at the 3' end, and 6 PS linkages at the internal positions of the gRNA or sgRNA sequence.

In some embodiments, the chemically modified gRNA or sgRNA comprises 2 PS linkages at the 5' end, 2 PS linkages at the 3' end, and 0 PS linkage (i.e., no modification) at the internal position of the gRNA or sgRNA sequence. In some embodiments, the chemically modified gRNA or sgRNA comprises 2 PS linkages at the 5' end and 2 PS linkages at the 3' end and 1 PS linkage at the internal position of the gRNA or sgRNA sequence. In some embodiments, the chemically modified gRNA or sgRNA comprises 2 PS linkages at the 5' end and 2 PS linkages at the 3' end and 2 PS linkages at the internal positions of the gRNA or sgRNA sequence. In some embodiments, the chemically modified gRNA or sgRNA comprises 2 PS linkages at the 5' end and 2 PS linkages at the 3' end and 3 PS linkages at the internal positions of the gRNA or sgRNA sequence. In some embodiments, the chemically modified gRNA or sgRNA comprises 2 PS linkages at the 5' end and 2 PS linkages at the 3' end and 4 PS linkages at the internal positions of the gRNA or sgRNA sequence. In some embodiments, the chemically modified gRNA or sgRNA comprises 2 PS linkages at the 5' end and 2 PS linkages at the 3' end and 5 PS linkages at the internal positions of the gRNA or sgRNA sequence. In some embodiments, the chemically modified gRNA or sgRNA comprises 2 PS linkages at the 5' end and 2 PS linkages at the 3' end and 6 PS linkages at the internal positions of the gRNA or sgRNA sequence.

In some embodiments, the chemically modified gRNA or sgRNA comprises 3 PS linkages at the 5' end, 3 PS linkages at the 3' end, and 0 PS linkage (i.e., no modification) at the internal position of the gRNA or sgRNA sequence. In some embodiments, the chemically modified gRNA or sgRNA comprises 3 PS linkages at the 5' end and 3 PS linkages at the 3' end and 1 PS linkage at the internal position of the gRNA or sgRNA sequence. In some embodiments, the chemically modified gRNA or sgRNA comprises 3 PS linkages at the 5' end and 3 PS linkages at the 3' end and 2 PS linkages at the internal positions of the gRNA or sgRNA sequence. In some embodiments, the chemically modified gRNA or sgRNA comprises 3 PS linkages at the 5' end and 3 PS linkages at the 3' end and 3 PS linkages at the internal positions of the gRNA or sgRNA sequence. In some embodiments, the chemically modified gRNA or sgRNA comprises 3 PS linkages at the 5' end and 3 PS linkages at the 3' end and 4 PS linkages at the internal positions of the gRNA or sgRNA sequence. In some embodiments, the chemically modified gRNA or sgRNA comprises 3 PS linkages at the 5' end and 3 PS linkages at the 3' end and 5 PS linkages at the internal positions of the gRNA or sgRNA sequence. In some embodiments, the chemically modified gRNA or sgRNA comprises 3 PS linkages at the 5' end and 3 PS linkages at the 3' end and 6 PS linkages at the internal positions of the gRNA or sgRNA sequence.

In some embodiments, the chemically modified gRNA or sgRNA comprises additional modified or unmodified nucleotide (N) with phosphodiester linkage, wherein N is an A, C, G, U, dA (deoxyA), dC (deoxyC), dG (deoxyG), or T, and any combinations thereof. In some embodiments, the chemically modified gRNA or sgRNA comprises 1, 2, 3, 4, or 5 additional N with phosphodiester linkage, wherein N is an A, G, U, dA, dG, dC, or T, and any combinations thereof. In some embodiments, the chemically modified gRNA or sgRNA comprises 1, 2, 3, 4, or 5 additional N with phosphodiester linkage at the 5' or 3' end. In one embodiment, the chemically modified gRNA or sgRNA comprises 1, 2, 3, 4, or 5 additional N with phosphodiester linkage at the 5' end. In a preferred embodiment, the chemically modified gRNA or sgRNA comprises 1, 2, 3, 4, or 5 additional N with phosphodiester linkage at the 3' end. In some embodiments, the chemically modified gRNA or sgRNA comprises 1, 2, 3, 4, or 5 additional N with phosphodiester linkage and each N is the same modified or unmodified nucleotide. For example, the chemically modified gRNA or sgRNA may comprise 4 additional N with phosphodiester linkage and each N of the 4 additional N is A, C, G, U, dA, dC, dG, or T. For example, the chemically modified gRNA or sgRNA may comprise 4 additional N with phosphodiester linkage and each N of the 4 additional N is A. For example, the chemically modified gRNA or sgRNA may comprise 3 additional N with phosphodiester linkage and each N of the 3 additional N is A, C, G, U, dA, dC, dG, or T. For example, the chemically modified gRNA or sgRNA may comprise 3 additional N with phosphodiester linkage and each N of the 3 additional N is A. For example, the chemically modified gRNA or sgRNA may comprise 3 additional N with phosphodiester linkage and each N of the 3 additional N is C. For example, the chemically modified gRNA or sgRNA may comprise 3 additional N with phosphodiester linkage and each N of the 3 additional N is G. For example, the chemically modified gRNA or sgRNA may comprise 3 additional N with phosphodiester linkage and each N of the 3 additional N is U. For example, the chemically modified gRNA or sgRNA may comprise 3 additional N with phosphodiester linkage and each N of the 3 additional N is dA. For example, the chemically modified gRNA or sgRNA may comprise 3 additional N with phosphodiester linkage and each N of the 3 additional N is dC. For example, the chemically modified gRNA or sgRNA may comprise 3 additional N with phosphodiester linkage and each N of the 3 additional N is dG. For example, the chemically modified gRNA or sgRNA may comprise 3 additional N with phosphodiester linkage and each N of the 3 additional N is T.

In some embodiments, the chemically modified gRNA or sgRNA comprises additional Uracil (U) with phosphodiester linkage at the 5' or 3' end. In one embodiment, the chemically modified gRNA or sgRNA comprises additional U with phosphodiester linkage at the 5' end. In a preferred embodiment, the chemically modified gRNA or sgRNA comprises additional U with phosphodiester linkage at the 3' end. In some embodiments, the chemically modified gRNA or sgRNA comprises 1, 2, 3, 4, or 5 additional U with phosphodiester linkage at the 5' or 3' end. In some embodiments, the chemically modified gRNA or sgRNA comprises 1 additional U with phosphodiester linkage at the 5' end. In some embodiments, the chemically modified gRNA or sgRNA comprises 1 additional U with phosphodiester linkage at the 3' end. In some embodiments, the chemically modified gRNA or sgRNA comprises 2 additional U with phosphodiester linkage at the 5' end. In some embodiments, the chemically modified gRNA or sgRNA comprises 2 additional U with phosphodiester linkage at the 3' end. In some embodiments, the chemically modified gRNA or sgRNA comprises 3 additional U with phosphodiester linkage at the 5' end. In a preferred embodiment, the chemically modified gRNA or sgRNA comprises 3 additional U with phosphodiester linkage at the 3' end. In some embodiments, the chemically modified gRNA or sgRNA comprises 4 additional U with phosphodiester linkage at the 5' end. In some embodiments, the chemically modified gRNA or sgRNA comprises 4 additional U with phosphodiester linkage at the 3' end. In some embodiments, the chemically modified gRNA or sgRNA comprises 5 additional U with phosphodiester linkage at the 5' end. In some embodiments, the chemically modified gRNA or sgRNA comprises 5 additional U with phosphodiester linkage at the 3' end.

In some embodiments, the chemically modified gRNA or sgRNA comprises a ribonebularine (depicted as "X" in this application, e.g., in Table 1 or Table 24). In some embodiments, the chemically modified gRNA or sgRNA comprises 0, 1, 2, 3, 4, 5, 6, 7, 8, 9, or 10 ribonebularines. In some embodiments, the chemically modified gRNA or sgRNA does not comprise ribonebularine. In some embodiments, the chemically modified gRNA or sgRNA comprises 1 ribonebularine. In some embodiments, the chemically modified gRNA or sgRNA comprises 2 ribonebularines. In some embodiments, the chemically modified gRNA or sgRNA comprises 3 ribonebularines. In some embodiments, the chemically modified gRNA or sgRNA comprises 4 ribonebularines. In some embodiments, the chemically modified gRNA or sgRNA comprises 5 ribonebularines. In some embodiments, the chemically modified gRNA or sgRNA comprises 6 ribonebularines. In some embodiments, the chemically modified gRNA or sgRNA comprises 7 ribonebularines. In some embodiments, the chemically modified gRNA or sgRNA comprises 8 ribonebularines. In some embodiments, the chemically modified gRNA or sgRNA comprises 9 ribonebularines. In some embodiments, the chemically modified gRNA or sgRNA comprises 10 ribonebularines. In some embodiments, the nebularine replaces an adenine in an unmodified gRNA or sgRNA or sgRNA or sgRNA. In some embodiments, the nebularine is in the spacer sequence. In some embodiments, the nebularine is in a tracrRNA sequence. In some embodiments, the nebularine is in a crRNA sequence in the tracrRNA sequence. In some embodiments, the nebularine is in a stem loop structure in the tracrRNA sequence.

In some embodiments, the chemically modified gRNA or sgRNA comprises a 2'-O-methylnebularine (depicted as "x" in this application, e.g., in Table 1 or Table 24). In some embodiments, the chemically modified gRNA or sgRNA comprises 0, 1, 2, 3, 4, 5, 6, 7, 8, 9, or 10 2'-O-methylnebularines. In some embodiments, the chemically modified gRNA or sgRNA does not comprise 2'-O-methylnebularine. In some embodiments, the chemically modified gRNA or sgRNA comprises 1 2'-O-methylnebularine. In some embodiments, the chemically modified gRNA or sgRNA comprises 2 2'-O-methylnebularines. In some embodiments, the chemically modified gRNA or sgRNA comprises 3 2'-O-methylnebularines. In some embodiments, the chemically modified gRNA or sgRNA comprises 4 2'-O-methylnebularines. In some embodiments, the chemically modified gRNA or sgRNA comprises 5 2'-O-methylnebularines. In some embodiments, the chemically modified gRNA or sgRNA comprises 6 2'-O-methylnebularines. In some embodiments, the chemically modified gRNA or sgRNA comprises 7 2'-O-methylnebularines. In some embodiments, the chemically modified gRNA or sgRNA comprises 8 2'-O-methylnebularines. In some embodiments, the chemically modified gRNA or sgRNA comprises 9 2'-O-methylnebularines. In some embodiments, the chemically modified gRNA or sgRNA comprises 10 2'-O-methylnebularines. In some embodiments, the 2'-O-methylnebularine replaces an adenine in an unmodified gRNA or sgRNA or sgRNA or sgRNA. In some embodiments, the 2'-O-methylnebularine is in the spacer sequence. In some embodiments, the 2'-O-methylnebularine is in a tracrRNA sequence. In some embodiments, the 2'-O-methylnebularine is in a crRNA sequence in the tracrRNA sequence. In some embodiments, the 2'-O-methylnebularine is in a stem loop structure in the tracrRNA sequence.

In some embodiments, the chemically modified gRNA or sgRNA comprises a 2'-deoxynebularine (depicted as "dX" in this application, e.g., in Table 1 or Table 24). In some embodiments, the chemically modified gRNA or sgRNA comprises 0, 1, 2, 3, 4, 5, 6, 7, 8, 9, or 10 2'-deoxynebularine.

In some embodiments, the chemically modified gRNA or sgRNA does not comprise 2'-deoxynebularine. In some embodiments, the chemically modified gRNA or sgRNA comprises 1 2'-deoxynebularine. In some embodiments, the chemically modified gRNA or sgRNA comprises 2 2'-deoxynebularine. In some embodiments, the chemically modified gRNA or sgRNA comprises 3 2'-deoxynebularines. In some embodiments, the chemically modified gRNA or sgRNA comprises 4 2'-deoxynebularines. In some embodiments, the chemically modified gRNA or sgRNA comprises 5 2'-deoxynebularines. In some embodiments, the chemically modified gRNA or sgRNA comprises 6 2'-deoxynebularines. In some embodiments, the chemically modified gRNA or sgRNA comprises 7 2'-deoxynebularines. In some embodiments, the chemically modified gRNA or sgRNA comprises 8 2'-deoxynebularines. In some embodiments, the chemically modified gRNA or sgRNA comprises 9 2'-deoxynebularines. In some embodiments, the chemically modified gRNA or sgRNA comprises 10 2'-deoxynebularines. In some embodiments, the 2'-deoxynebularine replaces an adenine in an unmodified gRNA or sgRNA or sgRNA or sgRNA. In some embodiments, the 2'-deoxynebularine is in the spacer sequence. In some embodiments, the 2'-deoxynebularine is in a tracrRNA sequence. In some embodiments, the 2'-deoxynebularine is in a crRNA sequence in the tracrRNA sequence. In some embodiments, the 2'-deoxynebularine is in a stem loop structure in the tracrRNA sequence.

In some embodiments, the chemically modified gRNA or sgRNA comprises a 2'-O-methylribonucleotide (2'-OMe). In some embodiments, the chemically modified gRNA or sgRNA comprises from about 0 to about 70 2'-OMe. In some embodiments, the chemically modified gRNA or sgRNA comprises 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, or 70 2'-OMe. In some embodiments, the chemically modified gRNA or sgRNAs may comprise from about 0 to about 70 2'-OMe. In some embodiments, the chemically modified gRNA or sgRNAs may comprise from about 0 to about 10, about 0 to about 20, about 0 to about 30, about 0 to about 35, about 0 to about 40, about 0 to about 45, about 0 to about 50, about 0 to about 55, about 0 to about 60, about 0 to about 65, about 0 to about 70, about 10 to about 20, about 10 to about 30, about 10 to about 35, about 10 to about 40, about 10 to about 45, about 10 to about 50, about 10 to about 55, about 10 to about 60, about 10 to about 65, about 10 to about 70, about 20 to about 30, about 20 to about 35, about 20 to about 40, about 20 to about 45, about 20 to about 50, about 20 to about 55, about 20 to about 60, about 20 to about 65, about 20 to about 70, about 30 to about 35, about 30 to about 40, about 30 to about 45, about 30 to about 50, about 30 to about 55, about 30 to about 60, about 30 to about 65, about 30 to about 70, about 35 to about 40, about 35 to about 45, about 35 to about 50, about 35 to about 55, about 35 to about 60, about 35 to about 65, about 35 to about 70, about 40 to about 45, about 40 to about 50, about 40 to about 55, about 40 to about 60, about 40 to about 65, about 40 to about 70, about 45 to about 50, about 45 to about 55, about 45 to about 60, about 45 to about 65, about 45 to about 70, about 50 to about 55, about 50 to about 60, about 50 to about 65, about 50 to about 70, about 55 to about 60, about 55 to about 65, about 55 to about 70, about 60 to about 65, about 60 to about 70, or 65 to about 70 2'-OMe. In some embodiments, the chemically modified gRNA or sgRNAs may comprise from about 0, about 10, about 20, about 30, about 35, about 40, about 45, about 50, about 55, about 60, about 65, or about 70 2'-OMe. In some embodiments, the chemically modified gRNA or sgRNAs may comprise from at least about 0, about 10, about 20, about 30, about 35, about 40, about 45, about 50, about 55, about 60, or about 65 2'-OMe. In some embodiments, the chemically modified gRNA or sgRNAs may comprise from at most about 10, about 20, about 30, about 35, about 40, about 45, about 50, about 55, about 60, about 65, or about 70 2'-OMe. In some embodiments, the chemically modified gRNA or sgRNA does not comprise 2'-OMe. In some embodiments, the chemically modified gRNA or sgRNA comprises 62 2'-OMe. In some embodiments, the chemically modified gRNA or sgRNA comprises 54 2'-OMe.

In some embodiments, the chemically modified gRNA or sgRNA comprises 2'-OMe at the 5' end of the gRNA or sgRNA sequence. In some embodiments, the chemically modified gRNA or sgRNA comprises 2'-OMe at the 3' end of the gRNA or sgRNA sequence. In some embodiments, the chemically modified gRNA or sgRNA comprises 2'-OMe at the internal positions of the gRNA or sgRNA sequence. In some embodiments, the chemically modified gRNA or sgRNA comprises 2'-OMe at the 5' end, 3' end, or internal positions of the gRNA or sgRNA sequence. In some embodiments, the chemically modified gRNA or sgRNA comprises 2'-OMe at the 5' end, 3' end, and internal positions of the gRNA or sgRNA sequence. In some embodiments, the chemically modified gRNA or sgRNA does not comprise 2'-OMe at the positions 2, 3, 4, 23, 24, 25, 27, 31, or 42, or any combinations thereof, in the 5'—3' direction in the gRNA or sgRNA sequence. In some embodiments, the chemically modified gRNA or sgRNA does not comprise 2'-OMe at the positions 2, 3, 4, 23, 24, 25, 27, 31, and 42 in the 5'—3' direction in the gRNA or sgRNA sequence.

An exemplary chemically modified gRNA or sgRNA sequence is shown below:

```
                                      (SEQ ID NO: 55)
5'-
csasgsGUUCCAUGGGAUGCUCUgUUUUAGagcuaGaaauagcaaGUUa AaAuAaggCUaGUCcGUUAucAAcuuGaaaaaguGgcaccgAgUCggug cusususu-3
``` wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

An exemplary chemically modified spacer sequence is shown below:

```
                                      (SEQ ID NO: 56)
     5'-csasgsGUUCCAUGGGAUGCUCU-3'
``` wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

An exemplary chemically modified tracrRNA sequence is shown below:

(SEQ ID NO: 57)
5'-gUUUUAGagcuaGaaauagcaaGUUaAaAuAaggCUaGUCcGUUAu cAAcuuGaaaaaguGgcaccgAgUCggugcusususu-3' wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

Another exemplary chemically modified gRNA or sgRNA sequence is shown below:

(SEQ ID NO: 55)
5'-csasgsGUUCCAUGGGAUGCUCUgUUUUAGagcuagaaauagcaaGU

UaAaAuAaggcuaGUccGUUAucAAcuugaaaaagugGcaccgagucggu gcusususu-3' wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

Another exemplary chemically modified tracrRNA sequence is shown below:

(SEQ ID NO: 57)
5'-gUUUUAGagcuagaaauagcaaGUUaAaAuAaggcuaGUccGUUAuc

AAcuugaaaaagugGcaccgagucggugcusususu-3'

Another exemplary chemically modified guide RNA sequence is shown below:

(SEQ ID NO: 58)
5'-cscscsGCACCTTGGCGCAGCGGGUUUUAGAGCUAGAAAUAGCAAGU

UAAAAUAAGGCUAGUCCGUUAUCAACUUGAAAAAGUGGCACCGAGUCGGU

GCUsususu-3', wherein the uppercase A, U, G, or C denote a ribonucleotide adenosine, adenine, uridine, guanine, and cytidine, and "s" denotes phosphorothioate (PS) linkage.

Another exemplary chemically modified guide RNA sequence is shown below:

(GA091)
(SEQ ID NO: 59)
5'-asasgsAUACCUGAAUAACCCUCgUUUUAGAGCUAGAAAUAGCAAGU

UAAAAUAAGGCUAGUCCGUUAUCAACUUGAAAAAGUGGCACCGAGUCGGU

GCUsususu-3'

Another exemplary chemically modified guide RNA sequence is shown below:

(GA098)
(SEQ ID NO: 60)
5'-asasgsAUACCUGAAUAACCCUCgUUUUAGAgcuagaaauagcAAGU

UAAAAUAAGGCUAGUCCGUUAUCAacuugaaaaaguggcaccgagucggu gcusususu 3' wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

Another exemplary chemically modified guide RNA sequence is shown below:

(GA099)
(SEQ ID NO: 59)
5'-asasgsAUACCUGAAUAACCCUCgUUUUAGagcuaGaaauagcaaGU

UaAaAuAaggCUaGUCcGUUAucAAcuuGaaaaaguGgcaccgAgUCggu gcusususu-3' wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

Another exemplary chemically modified guide RNA sequence is shown below:

(GA100)
(SEQ ID NO: 59)
5'-asasgsAUACCUGAAUAACCCUCgUUUUAGagcuagaaauagcaaGU

UaAaAuAaggcuaGUccGUUAucAAcuugaaaaagugGcaccgagucggu gcusususu-3' wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

Another exemplary chemically modified guide RNA sequence is shown below:

(GA385)
(SEQ ID NO: 11)
5'-cscscsGCACCUUGGCGCAGCGGgUUUUAGagcuagaaauagcaaGU

UaAaAuAaggcuaGUccGUUAucAAcuugaaaaagugGcaccgagucggu gcusususuuuu-3' wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

Another exemplary chemically modified guide RNA sequence is shown below:

(GA386)
(SEQ ID NO: 11)
5'-cscscsGCACCUUGGCGCAGCGGgUUUUAGagcuagaaauagcaaGU

UaAaAuAaggcuaGUccGUUAucAAcuugaaaaagugGcaccgagucggu gcusususuuUu-3', wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

Another exemplary chemically modified guide RNA sequence is shown below:

(GA387)

(SEQ ID NO: 12)
5'-cscscsGCACCUUGGCGCAGCGgUUUUAGagcuaGaaauagcaaGUU aAaAuAaggcuaGUccGUUAucAAcuuGaaaaagugGcaccgagucggug cuususuuuu-3', wherein the uppercase A, U, G, or C denote a ribonucleotide adenosine, uridine, guanine, or cytidine, the lowercase a, u, g, and c indicate 2'-O-Methyl-modified adenine, uridine, guanine, and cytidine, and "s" denotes phosphorothioate (PS) linkage.

Additional chemically modified guide RNA sequences and target gene information are provided in Table 1 or Table 24.

In some embodiments, the chemical modification comprises a phosphorothioate linkage (PS). In some embodiments, the sgRNA comprises a phosphorothioate linkage (PS) at a 5' end or at a 3' end. In some embodiments, the sgRNA comprises two and no more than two contiguous phosphorothioate linkages (PS) at the 5' end or at the 3' end. In some embodiments, the sgRNA comprises three contiguous phosphorothioate linkages (PS) at the 5' end or at the 3' end. In some embodiments, the sgRNA comprises the sequence 5'-UsUsU-3' at the 3'end or at the 5' end, wherein U indicates a uridine and wherein s indicates a phosphorothioate linkage (PS).

In some aspects, provided herein, is an sgRNA that comprises (i) a spacer sequence and (ii) a tracrRNA sequence, wherein the spacer sequence hybridizes with a target polynucleotide sequence in a PCSK9 gene or an ANGPTL3 gene when contacted with the target polynucleotide sequence, wherein the tracrRNA sequence binds a Cas protein in a base editor system when contacted with the base editor system, and wherein the sgRNA comprises a nebularine or a deoxynebularine. In some embodiments, the nebularine or the deoxynebularine replaces an adenine in an unmodified sgRNA. In some embodiments, the nebularine or the deoxynebularine is in the spacer sequence. In some embodiments, wherein the nebularine or the deoxynebularine is in the tracrRNA sequence. In some embodiments, the nebularine or the deoxynebularine is in a tracrRNA sequence. In some embodiments, the nebularine or the deoxynebularine is in a crRNA sequence in the tracrRNA sequence. In some embodiments, the nebularine or the deoxynebularine is in a stem loop structure in the tracrRNA sequence.

In some aspects, provided herein, is a single guide RNA that comprises a sequence selected from Table 1 or Table 24, wherein a, u, g, and c indicate 2'-OMe modified adenine, uridine, guanine, and cytidine, wherein s indicates a phosphorothioate (PS) linkage.

In some embodiments, the chemically modified guide RNA comprises an unmodified tracrRNA sequence (SEQ ID NO: 61)
GUUUUAGAGCUAGAAAUAGCAAGUUAAAAUAAGGCUAGUCCGUUAUCAAC

UUGAAAAAGUGGCACCGAGUCGGUGCUUUU.

In some embodiments, the chemically modified guide RNA comprises a tracrRNA sequence (SEQ ID NO: 61)
GUUUUAGAGCUAGAAAUAGCAAGUUAAAAUAAGGCUAGUCCGUUAUCAAC

UUGAAAAAGUGGCACCGAGUCGGUGCUUUU, which comprises 1 or more modification.

In some embodiments, the chemically modified guide RNA comprises an oligonucleotide that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the chemically modified guide RNAs listed in Table 1 or Table 24. In some embodiments, the chemically modified guide RNA comprises any one of the chemically modified guide RNAs listed in Table 1 or Table 24. In some embodiments, the chemically modified guide RNA is any one of the chemically modified guide RNAs listed in Table 1 or Table 24. In some embodiments, the chemically modified guide RNA comprises an oligonucleotide that is at least 60%, at least 65%, at least 70%, at least 75%, at least 80%, at least 85%, at least 90%, at least 95%, at least 96%, at least 97%, at least 98%, at least 99%, at least 99.5%, at least 99.7%, or at least 99.9% identical to any one of the chemically modified guide RNAs of SEQ ID NOs: 9-11, 55, 59, 253-452, 1618-1635, 1637-1800, 1802-2135, and 2191. In some embodiments, the chemically modified guide RNA comprises any one of the chemically modified guide RNAs of SEQ ID NOs: 9-11, 55, 59, 253-452, 1618-1635, 1637-1800, 1802-2135, and 2191. In some embodiments, the chemically modified guide RNA is any one of the chemically modified guide RNAs of SEQ ID NOs: 9-11, 55, 59, 253-452, 1618-1635, 1637-1800, 1802-2135, and 2191.

Base Editing at Splice Sites

In an aspect, provided herein are base editor systems and methods of using same for modifying target genes by generating a genetic alteration in the DNA sequence that occurs at the boundary of an exon and an intron (splice site) at a splice site of a target gene. In some embodiments, the base editor system modifies a nucleobase at a splice acceptor site of a target gene. In some embodiments, the base editor system modifies a nucleobase at a splice donor site of a target gene. Modification at a splice donor or splice acceptor site may result in alternated transcripts. In some embodiments, modification at a splice donor or splice acceptor site results in aberrant transcripts. In some embodiments, modification at a splice donor or splice acceptor site results in unstable transcripts that are subject to degradation upon transcription. In some embodiments, modification at a splice donor or splice acceptor site results in a premature stop codon in the transcript. In certain embodiments, the methods comprise knocking out or knocking down genes by targeting splice acceptor-splice donor (SA-SD) sites or premature STOP (pmSTOP) sites. For such methods, guide polynucleotides are designed to disrupt one or more slice acceptor/donor sites within the target nucleotide sequence. In some embodiments, a guide polynucleotide, e.g. a single guide RNA comprises a sequence of at least 10 contiguous nucleotides or a sequence of 17-23 contiguous nucleotides, that is complementary to a target sequence in the genome of an organism and comprises a target base pair.

Disruptions at SA-SD sites are particularly advantageous because one may knock out coding sequence and non-coding RNAs (ncRNAs) without stop codon read through.

Efficiency of base editing can be determined on the genomic level by EditR analysis of Sanger sequencing traces or by next generation sequencing (NGS), and also on the protein level by flow cytometry. Splice acceptor-splice donor base editing gRNAs that target the splice donor regions and the splice acceptor region exhibit base conversion efficiency of at least 5% and, in some cases, at least 80% or greater (e.g., 5%, 10%, 15%, 20%, 25%, 30%, 35%, 40%, 45%, 50%, 55%, 60%, 65%, 70%, 75%, 80%, 85%, 90%, 95%, 99%). In some cases, SA-SD gRNAs are significantly more efficient at C-to-T conversions than gRNAs that introduce premature stop codons disrupting.

Guide RNAs for targeting SA-SD sites can be designed using an R based program that identifies gRNAs targeting all ncRNAs and protein coding gene SA-SD sites. In some cases, the user supplies the reference genome, Ensembl transcript ID of the reference sequence, protospacer adjacent motif (PAM) site, and distance to subset upstream and downstream of exon-intron boundary. The program extracts sequences of 20 base pairs+the PAM length upstream and 15 base pairs downstream of an exon-intron boundary, as well as the splice site motif. In some embodiments, a guide molecule can be from 20 to 120 bases in length, or more. In certain embodiments, a guide molecule can be from 20 to 60 bases in length, or 20 to 50 bases, or 30 to 50 bases, or 39 to 46 bases.

In some cases, it is advantageous to use chemically modified gRNAs having increased stability when transfected into mammalian cells. For example, gRNAs can be chemically modified to comprise 2'-O-methyl phosphorthioate modifications on at least one 5' nucleotide and at least one 3' nucleotide of each gRNA. In some cases, the three terminal 5' nucleotides and three terminal 3' nucleotides are chemically modified to comprise 2'-O-methyl phosphorthioate modifications.

In an aspect, provided herein are base editing systems and methods for targeting diseases for base editing disruption. The target sequence can be any disease-associated polynucleotide or gene, as have been established in the art.

Without being bound by a particular theory, where the goal is to disrupt a gene in vivo for a therapeutic purpose, cytosine base editors may be used to directly introduce stop codons into the coding sequence of the gene (nonsense mutations) by altering specific codons for glutamine (CAG-TAG, CAA-TAA), arginine (CGA-TGA), and tryptophan (TGG-TAG/TAA/TGA, with editing of cytosines on the antisense strand). In certain embodiments, adenine base editors may be used to disrupt gene function and/or expression by modifying nucleobases at splice sites of target genes. The more favorable off-target profile of adenine base editors, particularly with respect to gRNA-independent off-target DNA base editing, recommend the use of adenine base editors over cytosine base editors for therapeutic purposes. In some embodiments, a base editor, e.g. an adenosine nucleobase editor as describe herein may be used to disrupt a splice donors at the 5' ends of introns or splice acceptors at the 3' ends of introns. In some embodiments, splice site disruption results in the inclusion of intronic sequences in messenger RNA (mRNA)-potentially introducing nonsense, frameshift, or in-frame indel mutations that result in premature stop codons or in insertion/deletion of amino acids that disrupt protein activity- or in the exclusion of exonic sequences, which can also introduce nonsense, frameshift, or in-frame indel mutations.

Canonical splice donors comprise the DNA sequence GT on the sense strand, whereas canonical splice acceptors comprise the DNA sequence AG. In some embodiments, a base editor, e.g. an adenosine nucleobase editor as described herein can be used to generate alteration of the sequence disrupts normal splicing. In some embodiments, the adenosine base editor disrupts a complementary base in the second position in the antisense strand (GT-GC). In some embodiments, the adenosine base editor disrupts the first position in the sense strand (AG-GG).

Examples of useful applications of mutation or disruption of an endogenous gene sequence that reduces or abolishes expression of the target gene related to the disease, with significantly reduced off-target effect, indels frequency, and/or other unintended genetic interruptions related to double stranded breaks that result from traditional CRISPR-Cas9 nuclease modification. In some embodiments, the target gene is a PCSK9 gene. In some embodiments, the target gene is an ANGPTL3 gene.

The chemically modified gRNAs or sgRNAs of the present disclosure can enhance or increase the binding affinity between a programmable DNA binding component of a base editor fusion protein, such as a Cas protein (e.g., a Cas9 protein, a nuclease inactive Cas9 protein, a Cas9 nickase) and guide RNAs (e.g., gRNAs or sgRNAs). In some embodiments, the chemically modified gRNAs or sgRNAs of the present disclosure can enhance or increase the binding affinity between a Cas protein and gRNAs or sgRNAs by at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% compared to unmodified gRNAs or sgRNAs. In some embodiments, the chemically modified gRNAs or sgRNAs of the present disclosure can enhance or increase the binding affinity between a Cas protein, e.g. a Cas9 protein, a nuclease inactive Cas9 protein, a Cas9 nickase, and gRNAs or sgRNAs by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared to unmodified gRNAs or sgRNAs. In some embodiments, the chemically modified gRNAs or sgRNAs of the present disclosure can enhance or increase the binding affinity between a base editor fusion or Cas protein and gRNAs or sgRNAs by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared unmodified gRNAs or sgRNAs. In some embodiments, the chemically modified gRNAs or sgRNAs of the present disclosure can enhance or increase the binding affinity between a Cas protein or component of a base editor fusion protein and gRNAs or sgRNAs by at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold compared to unmodified gRNAs or sgRNAs.

The chemically modified gRNAs or sgRNAs of the present disclosure can enhance or increase the binding affinity between a programmable DNA binding component of a base editor fusion protein, such as a Cas protein (e.g., a Cas9 protein, a nuclease inactive Cas9 protein, a Cas9 nickase) and the tracrRNA sequence of the guide RNAs (e.g., gRNAs or sgRNAs). In some embodiments, the chemically modified gRNAs or sgRNAs of the present disclosure can enhance or increase the binding affinity between a base editor fusion or Cas protein and the tracrRNA sequence of the gRNAs or sgRNAs by at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% compared to unmodified gRNAs or sgRNAs. In some embodiments, the chemically modified gRNAs or sgRNAs of the present disclosure can enhance or increase the binding affinity between a base editor fusion or Cas protein and the tracrRNA sequence of the gRNAs or sgRNAs by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared to unmodified gRNAs or sgRNAs. In some embodiments, the chemically modified gRNAs or sgRNAs of the present disclosure can enhance or increase the binding affinity between a base editor fusion or Cas protein and the tracrRNA sequence of the gRNAs or sgRNAs by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared unmodified gRNAs or sgRNAs. In some embodiments, the chemically modified gRNAs or sgRNAs of the present disclosure can enhance or increase the binding affinity between a base editor fusion or Cas protein and the tracrRNA sequence of the gRNAs or sgRNAs by at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold compared to unmodified gRNAs or sgRNAs.

In some embodiments, the tracrRNA sequence of the gRNAs or sgRNAs may bind a programmable DNA binding component of a base editor fusion protein, such as a Cas protein (, ) with increased binding affinity compared to a tracrRNA sequence in an unmodified sgRNA. The type II Cas protein may be used as a system or base editor as described herein.

In some embodiments, the tracrRNA sequence of the gRNAs or sgRNAs may bind a Type II Cas protein with at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% increased binding affinity compared to a tracrRNA sequence in an unmodified sgRNA. In some embodiments, the tracrRNA sequence of the gRNAs or sgRNAs may bind a base editor comprising a Type II Cas protein with at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold increased binding affinity compared to a tracrRNA sequence in an unmodified sgRNA. In some embodiments, the tracrRNA sequence of the gRNAs or sgRNAs may bind a base editor fusion protein comprising a Cas9 protein with increased binding affinity compared to a tracrRNA sequence in an unmodified sgRNA.

In some embodiments, the tracrRNA sequence of the gRNAs or sgRNAs may bind a Cas9 protein with at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, or 300% increased binding affinity compared to a tracrRNA sequence in an unmodified sgRNA. In some embodiments, the tracrRNA sequence of the gRNAs or sgRNAs may bind a base editor fusion protein comprising a Cas9 protein with at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold increased binding affinity compared to a tracrRNA sequence in an unmodified sgRNA.

The chemically modified gRNAs or sgRNAs of the present disclosure can reduce off-target effect in gene modification (e.g., gene or genome editing) of the target sequence. In some embodiments, the chemically modified gRNAs or sgRNAs of the present disclosure can reduce off-target effect in gene modification of the target sequence by at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% compared to unmodified gRNAs or sgRNAs. In some embodiments, the chemically modified gRNAs or sgRNAs of the present disclosure can reduce off-target effect in gene modification of the target sequence by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared to unmodified gRNAs or sgRNAs. In some embodiments, the chemically modified gRNAs or sgRNAs of the present disclosure can reduce off-target effect in gene modification of the target sequence by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared unmodified gRNAs or sgRNAs. In some embodiments, the chemically modified gRNAs or sgRNAs of the present disclosure can reduce off-target effect in gene modification of the target sequence by at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold compared to unmodified gRNAs or sgRNAs.

In some embodiments, the target polynucleotide sequence is in a genome, wherein the gRNA or sgRNA is capable of directing a component (e.g. Cas9) of a base editor fusion protein to effect a modification in the target polynucleotide sequence, and wherein the modification results in less off-target effect in the genome as compared to an unmodified gRNA or sgRNA. In some embodiments, the gRNA or sgRNA is capable of directing a Type II Cas protein to effect a modification in the target polynucleotide sequence wherein the modification results in at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% less off-target effect in the genome as compared to an unmodified gRNA or sgRNA. In some embodiments, the gRNA or sgRNA is capable of directing a Type II Cas protein of a base editor fusion protein to effect a modification in the target polynucleotide sequence wherein the modification results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less off-target effect in the genome as compared to an unmodified gRNA or sgRNA. In some embodiments, the target polynucleotide sequence is in a genome, wherein the gRNA or sgRNA is capable of directing a Cas9 protein to effect a modification in the target polynucleotide sequence, and wherein the modification results in less off-target effect in the genome as compared to an unmodified gRNA or sgRNA. In some embodiments, the gRNA or sgRNA is capable of directing a Cas9 protein to effect a modification in the target polynucleotide sequence wherein the modification results in at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% less off-target effect in the genome as compared to an unmodified gRNA or sgRNA. In some embodiments, the gRNA or sgRNA is capable of directing a Cas9. In some embodiments, the target polynucleotide sequence is in a genome, wherein the gRNA or sgRNA is capable of directing a base editor fusion protein to effect a modification in the target polynucleotide sequence, and wherein the modification results in less off-target effect in the genome as compared to an unmodified gRNA or sgRNA. In some embodiments, the gRNA or sgRNA is capable of directing a base editor fusion protein to effect a modification in the target polynucleotide sequence wherein the modification results in at least 1%, 2%, 3%, 4%, 5%, 6%, 7%, 8%, 90%,%, 10%, 11, 12%, %13%, %14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% less off-target effect in the genome as compared to an unmodified gRNA or sgRNA. In some embodiments, the gRNA or sgRNA is capable of directing a base editor fusion protein to effect a modification in the target polynucleotide sequence wherein the modification results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less off-target effect in the genome as compared to an unmodified gRNA or sgRNA. In some embodiments, the modification using the chemically modified gRNAs or sgRNAs results in less off-target effect in a cell as compared to an unmodified gRNA or sgRNA. In some embodiments, the modification using the chemically modified gRNAs or sgRNAs results in at least 1%, 2%, 3%, 4%, 5%, 6%, 7%, 8%, 9%, 10%, 110, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% less off-target effect in a cell as compared to an unmodified gRNA or sgRNA. In some embodiments, the modification using the chemically modified gRNAs or sgRNAs results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less off-target effect in a cell as compared to an unmodified gRNA or sgRNA.

The chemically modified gRNAs or sgRNAs of the present disclosure can enhance or increase the gene modification (e.g., gene or genome editing) efficiency. In some embodiments, the chemically modified gRNAs or sgRNAs of the present disclosure can enhance or increase the gene modification (e.g., gene or genome editing) efficiency by at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% compared to unmodified gRNAs or sgRNAs. In some embodiments, the chemically modified gRNAs or sgRNAs of the present disclosure can enhance or increase the gene modification (e.g., gene or genome editing) efficiency by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared to unmodified gRNAs or sgRNAs. In some embodiments, the chemically modified gRNAs or sgRNAs of the present disclosure can enhance or increase the gene modification (e.g., gene or genome editing) efficiency by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared unmodified gRNAs or sgRNAs. In some embodiments, the chemically modified gRNAs or sgRNAs of the present disclosure can enhance or increase the gene modification (e.g., gene or genome editing) efficiency by at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold compared to unmodified gRNAs or sgRNAs.

The chemically modified gRNAs or sgRNAs of the present disclosure can enhance or increase the stability of the complex of a base editor protein or component (e.g., Cas9 protein) and the guide RNAs (e.g., gRNAs or sgRNAs), for example, the stability of base editor complex. In some embodiments, the chemically modified gRNAs or sgRNAs of the present disclosure can enhance or increase the stability of the Cas protein-gRNA complex by at least 1%, 2%, 3%, 4%, 5%, 6%, 7%, 8%, 9%, %, 11%, 12%, 13%, %14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% compared to unmodified gRNAs or sgRNAs. In some embodiments, the chemically modified gRNAs or sgRNAs of the present disclosure can enhance or increase the stability of the base editor fusion or Cas protein-gRNA complex by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared to unmodified gRNAs or sgRNAs. In some embodiments, the chemically modified gRNAs or sgRNAs of the present disclosure can enhance or increase the stability of the base editor fusion or Cas protein-gRNA complex by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared unmodified gRNAs or sgRNAs. In some embodiments, the chemically modified gRNAs or sgRNAs of the present disclosure can enhance or increase the stability of the base editor fusion or Cas protein-gRNA complex by at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold compared to unmodified gRNAs or sgRNAs.

In some embodiments, the chemically modified gRNAs or sgRNAs of the present disclosure can enhance or increase the stability of the base editor complex by at least 1%, 2%, 3%, 4%, 5%, 6%, 7%, 8%, 9%, 10, 1%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% compared to unmodified sgRNAs. In some embodiments, the chemically modified gRNAs or sgRNAs of the present disclosure can enhance or increase the stability of the base editor complex by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared to unmodified sgRNAs. In some embodiments, the chemically modified gRNAs or sgRNAs of the present disclosure can enhance or increase the stability of the base editor complex by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared unmodified sgRNAs. In some embodiments, the chemically modified gRNAs or sgRNAs of the present disclosure can enhance or increase the stability of the base editor-sgRNA or Cas9-sgRNA complex by at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold compared to unmodified sgRNAs.

The chemically modified gRNAs or sgRNAs of the present disclosure can enhance or increase the stability of the guide RNAs (e.g., gRNAs or sgRNAs) in vitro, in vivo, and/or ex vivo. In some embodiments, the chemically modified gRNAs or sgRNAs of the present disclosure can enhance or increase the stability of the gRNAs or sgRNAs in vitro, in vivo, and/or ex vivo by at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% compared to unmodified gRNAs or sgRNAs. In some embodiments, the chemically modified gRNAs or sgRNAs of the present disclosure can enhance or increase the stability of the gRNAs or sgRNAs in vitro, in vivo, and/or ex vivo by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared to unmodified gRNAs or sgRNAs. In some embodiments, the chemically modified gRNAs or sgRNAs of the present disclosure can enhance or increase the stability of the gRNAs or sgRNAs in vitro, in vivo, and/or ex vivo by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% compared unmodified gRNAs or sgRNAs. In some embodiments, the chemically modified gRNAs or sgRNAs of the present disclosure can enhance or increase the stability of the gRNAs or sgRNAs in vitro, in vivo, and/or ex vivo by at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold compared to unmodified gRNAs or sgRNAs.

In some embodiments, the chemically modified gRNAs or sgRNAs exhibit increased stability in a cell as compared to unmodified gRNAs or sgRNAs. In some embodiments, the chemically modified gRNAs or sgRNAs exhibit at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% higher or increased stability in a cell as compared to unmodified gRNAs or sgRNAs.

In some embodiments, the chemically modified gRNAs or sgRNAs exhibit be at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold higher or increased stability in a cell as compared to unmodified gRNAs or sgRNAs.

In some embodiments, the stability of the chemically modified gRNAs or sgRNAs is measured by half-life of the gRNAs or sgRNAs in the cell. In some embodiments, the chemically modified gRNAs or sgRNAs exhibit increased half-life in the cell compared to unmodified gRNAs or sgRNAs. In some embodiments, the gRNAs or sgRNAs exhibit increased half-life in the cell by at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% as compared to unmodified gRNAs or sgRNAs. In some embodiments, the gRNAs or sgRNAs exhibit increased half-life in the cell by about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% as compared to unmodified gRNAs or sgRNAs. In some embodiments, the gRNAs or sgRNAs exhibit increased half-life in the cell by at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold as compared to unmodified gRNAs or sgRNAs.

The chemically modified gRNAs or sgRNAs of the present disclosure can be more resistant to degradation as compared to an unmodified gRNA or sgRNA. In some embodiments, the chemically modified gRNAs or sgRNAs of the present disclosure can be at least 1%, 2%, 3%, 4%, 5%, 6%, 7%, 8%, 9%, 10, 1%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, or 1000% more resistant to degradation compared to unmodified gRNAs or sgRNAs. In some embodiments, the chemically modified gRNAs or sgRNAs of the present disclosure can be about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% more resistant to degradation compared to unmodified gRNAs or sgRNAs. In some embodiments, the chemically modified gRNAs or sgRNAs of the present disclosure can be about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 20%, at least about 50%, at least about 100%, at least about 150%, at least about 200%, at least about 250%, or at least about 300% more resistant to degradation compared unmodified gRNAs or sgRNAs. In some embodiments, the chemically modified gRNAs or sgRNAs of the present disclosure can be at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold more resistant to degradation compared to unmodified gRNAs or sgRNAs.

Target Gene Modification

In some aspects, provided herein, is a method for treating or preventing a condition in a subject in need thereof, the method comprising administering to the subject the composition or lipid nanoparticle comprising chemically modified gRNAs or sgRNAs described herein, wherein the gRNAs or sgRNAs direct a base editor protein to effect a modification in a target polynucleotide sequence in a cell of the subject, thereby treating or preventing the condition. In some embodiments, the target polynucleotide is in a PCSK9 gene. In some embodiments, the target polynucleotide is in an ANGPTL3 gene. In some embodiments, the modification is at a splice site of the target polynucleotide. In some embodiments, the modification is at a splice donor site of the target polynucleotide. In some embodiments, the modification is at a splice acceptor site of the target polynucleotide. In some embodiments, the modification reduces expression of functional PCSK9 protein encoded by the PCSK9 gene in the subject. In some embodiments, the modification reduces expression of functional ANGPTL3 protein encoded by the ANGPTL3 gene in the subject. In some embodiments, the condition is atherosclerotic vascular disease. In some embodiments, the condition is an atherosclerotic vascular disease, hypertriglyceridemia, or diabetes. In some embodiments, the subject exhibits a reduced blood LDL cholesterol level and/or a reduced blood triglycerides level as compared to before the administration.

In some embodiments, the disclosure provides base-editing systems, compositions and methods for editing a polynucleotide encoding an Apolipoprotein C3 (APOC3) protein and variants thereof. In some embodiments, provided herein are genome/base-editing systems, compositions and methods for editing a polynucleotide encoding Proprotein convertase subtilisin/kexin type 9 (PCSK9) and variants thereof. In some embodiments, provided herein are genome/base-editing systems, compositions and methods for editing a polynucleotide encoding Angiopoietin-like 3 (ANGPTL3) and variants thereof. To edit a target gene, a target gene polynucleotide may contact the compositions disclosed herein comprising a sgRNA and a adenosine base editor protein, wherein the sgRNA comprises a spacer sequence and a tracrRNA sequence, wherein the spacer sequence hybridizes with a target polynucleotide sequence in a PCSK9 or ANGPTL3 gene and the tracrRNA sequence binds the adenosine base editor protein (e.g. a Cas9 component of the adenosine base editor).

In some embodiments, the sgRNA therefore directs the base editor protein to the target polynucleotide sequence to result in a to G modification in the target gene. In some embodiments, the target gene or target polynucleotide is selected from a gene encoding PCSK9, APOC3, LPA, and ANGPTL3. In some embodiments, the target polynucleotide sequence is in a PCSK9 gene. In some embodiments, the target polynucleotide sequence is in an ANGPTL3 gene. In some embodiments, the modification reduces or abolishes expression of functional PCSK9 protein encoded by the PCSK9 gene in the cell. In some embodiments, the modification reduces or abolishes expression of functional ANGPTL3 protein encoded by the ANGPTL3 gene in the cell. In some embodiments, the introduction is performed via a lipid nanoparticle that comprises the composition.

For example, the sgRNA and the Adenosine base editor protein may be expressed in a cell where a target gene editing is desired (e.g., a liver cell), to thereby allowing contact of the target gene with the composition disclosed herein (e.g., sgRNA and the Adenosine base editor protein). In some embodiments, the binding of the Adenosine base editor protein to its target polynucleotide sequence in the target gene is directed by a single guide RNA disclosed herein, e.g., a single guide RNA comprising (i) a spacer sequence and (ii) a tracrRNA sequence, wherein the spacer sequence hybridizes with a target polynucleotide sequence in a target gene. Thus, by designing the guide RNA sequence, the Adenosine base editor protein can be directed to edit any target polynucleotide sequence in the target gene (e.g., target gene encoding PCSK9, APOC3 and ANGPTL3). In some embodiments, the guide RNA sequence is co-expressed with the Adenosine base editor protein in a cell where editing is desired.

In some embodiments, a target gene comprising more than one mutations described herein are contemplated. For example, a target gene encoding a variant protein can be produced using the methods described herein that includes 1, 2, 3, 4, 5, 6, 7, 8, 9, 10, or more mutations. To make multiple mutations in the target gene, a plurality of guide RNA sequences can be used, each guide RNA sequence targeting one target polynucleotide sequence in the target gene. The Adenosine base editor protein is capable of editing each and every target polynucleotide sequence dictated by the guide RNA sequence. For example, 1, 2, 3, 4, 5, 6, 7, 8, 9, 10, or more guide RNA sequences can be used in a gene editing reaction. In some embodiments, the guide RNA sequences as used (e.g., gRNA). In some embodiments, DNA molecule encoding the guide RNA sequences can also be used.

In some embodiments, simultaneous modifications into more than one target genes (e.g., more than one target gene in the LDL-mediated cholesterol clearance pathway) are also contemplated herein. For example, in some embodiments, a modification may be simultaneously introduced into PCSK9 and APOC3 gene. In some embodiments, a modification may be simultaneously introduced into PCSK9 and LDL-R gene. In some embodiments, a modification may be simultaneously introduced into PCSK9 and IODL gene. In some embodiments, a modification may be simultaneously introduced into PCSK9 and LPA gene. In some embodiments, a modification may be simultaneously introduced into APOC3 and IODL gene. In some embodiments, a modification may be simultaneously introduced into LDL-R and APOC3 gene. In some embodiments, a modification may be simultaneously introduced into LDL-R and IDOL gene. In some embodiments, a modification may be simultaneously introduced into PCSK9, APOC3, LDL-R and IDOL gene. In some embodiments, a modification can be simultaneously introduced into PCSK9 and ANGPTL3 gene. To simultaneously introduce of modifications into more than one target genes, multiple guide nucleotide sequences are used.

To edit a gene encoding the PCSK9 or ANGPTL3 protein, the gene is contacted with the composition described herein. In some embodiments, a target polynucleotide sequence in a target gene is contacted with the single guide RNA disclosed herein and a Adenosine base editor protein or a nucleic acid sequence encoding the Adenosine base editor protein, wherein the single guide RNA directs the Adenosine base editor protein to effect a modification in the target gene (e.g., target gene encoding PCSK9, APOC3 and ANGPTL3). In some embodiments, the target polynucleotide sequence is the gene locus in the genomic DNA of a cell. In some embodiments, the cell is a cultured cell. In some embodiments, the cell is in vivo. In some embodiments, the cell is in vitro. In some embodiments, the cell is ex vivo.

In some embodiments, the cell is from a mammal. In some embodiments, the mammal is a human. In some embodiments, the mammal is a rodent. In some embodiments, the rodent is a mouse. In some embodiments, the rodent is a rat. As would be understood be those skilled in the art, a target polynucleotide sequence may be a DNA molecule comprising a coding strand and a complementary strand, e.g., the PCSK9 or ANGPTL3 gene locus in a genome. As such, the target polynucleotide sequence may also include coding regions (e.g., exons) and non-coding regions (e.g., introns or splicing sites). In some embodiments, the target polynucleotide sequence is located in the coding region (e.g., an exon) of the target gene (e.g., the PCSK9 or ANGPTL3 gene locus). As such, the modification in the coding region may result in an amino acid change in the protein encoded by the target gene, i.e., a mutation. In some embodiments, the mutation is a loss of function mutation. In some embodiments, the loss-of-function mutation is a naturally occurring loss-of-function mutation. In some embodiments, the target polynucleotide sequence is located in a non-coding region of the target gene, e.g., in an intron or a splicing site. In some embodiments, the base editor system provided herein results in a A·T to G·C alteration at a splice site in a PCSK9 gene or a ANGPTL3 gene. In some embodiments, the A·T to G·C alteration is at a splice acceptor site of the PCSK9 gene. In some embodiments, the A·T to G·C alteration results in an aberrant PCSK9 transcript encoded by the PCSK9 gene. In some embodiments, the A·T to G·C alteration results in a non-functional PCSK9 polypeptide encoded by the PCSK9 gene when expressed in a cell. In some embodiments, the A·T to G·C alteration is at a 5' end of a splice donor site of an intron 1 of the PCSK9 gene. In some embodiments, the A·T to G·C alteration is at a 5' end of a splice donor site of an intron 4 of the PCSK9 gene. In some embodiments, the base editor system provided herein results in a A·T to G·C alteration at a splice site ANGPTL3 gene, or the second A·T to G·C alteration is at a splice donor site of the ANGPTL3 gene. In some embodiments, the A·T to G·C alteration or the second A·T to G·C alteration is at a splice acceptor site of the ANTPTL3 gene. In some embodiments, the A·T to G·C alteration or the second A·T to G·C alteration results in an aberrant ANGPTL3 transcript encoded by the ANGPTL3 gene. In some embodiments, the A·T to G·C alteration or the second A·T to G·C alteration results in a non-functional ANGPTL3 polypeptide encoded by the ANGPTL3 gene. In some embodiments, the A·T to G·C alteration or the second A·T to G·C alteration is at a 5' end of a splice donor site of an intron 6 of the ANGPLT3 gene.

In some embodiments, a target polynucleotide sequence is located in a splicing site and the editing of such sequence causes alternative splicing of the mRNA of a target gene. In some embodiments, the alternative splicing leads to leading to loss-of-function mutants. In some embodiments, the alternative splicing leads to the introduction of a premature stop codon in a mRNA encoded by the target gene, resulting in truncated and unstable proteins. In some embodiments, mutants that are defective in folding are produced. A loss-of-function variant generated by a gene that is modified using the compositions and methods disclosed herein, may have reduced activity compared to a wild type protein encoded by an unmodified target gene. Activity refers to any known biological activity of the wild-type protein in the art.

In some embodiments, the activity of a loss-of-function variant may be reduced by at least 20%, at least 30%, at least 40%, at least 50%, at least 60%, at least 70%, at least 80%, at least 90%, at least 99%, or more. In some embodiments, the loss-of-function variant has no more than 50%, no more than 40%, no more than 30%, no more than 20%, no more than 10%, no more than 5%, no more than 1% or less activity compared to a wild type protein.

In some embodiments, cellular activity of a protein encoded by a target gene may be reduced by reducing the level of properly folded and active protein. Introducing destabilizing mutations into the wild type protein may cause misfolding or deactivation of the protein. A variant generated by modifying a target gene using the compositions and methods disclosed herein comprises one or more destabilizing mutations may have reduced activity compared to the wild type protein encoded by an unmodified target gene. For example, the activity of a variant comprising one or more destabilizing mutations may be reduced by at least about 20%, at least about 30%, at least about 40%, at least about 50%, at least about 60%, at least about 70%, at least about 80%, at least about 90%, at least about 95%, at least about 99%, or more.

In some embodiments, the methods and composition disclosed herein reduces or abolishes expression and/or function of protein encoded by a target gene. For example, the methods and composition disclosed herein reduces expression and/or function of protein encoded by the target gene by at least 3-fold, at least 4-fold, at least 5-fold, at least 6-fold, at least 7-fold, at least 8-fold, at least 9-fold, or at least 10-fold relative to a control.

In some embodiments, the methods and composition disclosed herein reduces or abolishes expression and/or function of the protein encoded by a target gene by at least 2-fold relative to a control. For example, the methods and composition disclosed herein reduces or abolishes expression and/or function of the protein encoded by a target gene by at least 3-fold, at least 4-fold, at least 5-fold, at least 6-fold, at least 7-fold, at least 8-fold, at least 9-fold, or at least 10-fold relative to a control.

Some aspects of the present disclosure provide strategies of editing target gene to reduce the amount of full-length, functional protein being produced. In some embodiments, stop codons may be introduced into the coding sequence of target gene upstream of the normal stop codon (referred to as a "premature stop codon"). Premature stop codons cause premature translation termination, in turn resulting in truncated and nonfunctional proteins and induces rapid degradation of the mRNA via the non-sense mediated mRNA decay pathway. See, e.g., Baker et al., Current Opinion in Cell Biology 16 (3): 293-299, 2004; Chang et al, Annual Review of Biochemistry 76: 51-74, 2007; and Behm-Ansmant et ah, Genes & Development 20 (4): 391-398, 2006, each of which is incorporated herein by reference.

Proprotein Convertase Subtilisin-Kexin Type 9 (PCSK9)

In some embodiments, the target gene for modification using the compositions and methods disclosed herein is gene encoding PCSK9. Proprotein convertase subtilisin-kexin type 9 (PCSK9), also known as neural apoptosis-regulated convertase 1 (NARC-I), is a proteinase K-like subtilase identified as the 9th member of the secretory subtilase family. "Proprotein convertase subtilisin/kexin type 9 (PCSK9)" refers to an enzyme encoded by the PCSK9 gene. PCSK9 binds to the receptor for low-density lipoprotein (LDL) particles. In the liver, the LDL receptor removes LDL particles from the blood through the endocytosis pathway. When PCSK9 binds to the LDL receptor, the receptor is channeled towards the lysosomal pathway and broken down by proteolytic enzymes, limiting the number of times that a given LDL receptor is able to uptake LDL particles from the blood. Thus, blocking PCSK9 activity may lead to more LDL receptors being recycled and present on the surface of the liver cells, and will remove more LDL cholesterol from the blood.

Therefore, blocking PCSK9 can lower blood cholesterol levels. PCSK9 orthologs are found across many species. PCSK9 is inactive when first synthesized, a pre-pro enzyme, because a section of the peptide chain blocks its activity; proprotein convertases remove that section to activate the enzyme. Pro-PCSK9 is a secreted, globular, serine protease capable of proteolytic auto-processing of its N-terminal pro-domain into a potent endogenous inhibitor of PCSK9, which blocks its catalytic site. PCSK9's role in cholesterol homeostasis has been exploited medically. Drugs that block PCSK9 can lower the blood level of low-density lipoprotein cholesterol (LDL-C). The first two PCSK9 inhibitors, alirocumab and evolocumab, were approved by the U.S. Food and Drug Administration in 2015 for lowering cholesterol where statins and other drugs were insufficient.

The human gene for PCSK9 localizes to human chromosome Ip33-p34.3. PCSK9 is expressed in cells capable of proliferation and differentiation including, for example, hepatocytes, kidney mesenchymal cells, intestinal ileum, and colon epithelia as well as embryonic brain telencephalon neurons. See, e.g., Seidah et al., 2003 PNAS 100:928-933, which is incorporated herein by reference.

Original synthesis of PCSK9 is in the form of an inactive enzyme precursor, or zymogen, of 72-kDa, which undergoes autocatalytic, intramolecular processing in the endoplasmic reticulum (ER) to activate its functionality. This internal processing event has been reported to occur at the SSVFAQ ↓SIP motif, and has been reported as a requirement of exit from the ER. "↓" indicates cleavage site. See, Benjannet et al., 2004 J. Biol. Chem. 279:48865-48875, and Seidah et al, 2003 PNAS 100:928-933, each of which are incorporated herein by reference. The cleaved protein is then secreted. The cleaved peptide remains associated with the activated and secreted enzyme.

The gene sequence for human PCSK9 is ~22-kb long with 12 exons encoding a 692 amino acid protein. The protein sequence of human PCSK9 can be found, for example, at Deposit No. NP_777596.2, which sequence is incorporated herein in its entirety. Human, mouse and rat PCSK9 nucleic acid sequences have been deposited; see, e.g., GenBank Accession Nos.: AX127530 (also AX207686), AX207688, and AX207690, respectively, each of which sequence is incorporated herein in its entirety. The gene sequence of *Macaca fascicularis* can be found publically, for example, NCBI Gene ID: 102142788, which sequence is incorporated herein in their entirety. *Macaca fascicularis* proprotein convertase subtilisin/kexin type 9 isoform X2 sequence can be found publically, for example, at NCBI Reference Sequence: XP_005543317.1, which sequence is incorporated herein in its entirety.

The translated protein contains a signal peptide in the NH2-terminus, and in cells and tissues an about 74 kDa zymogen (precursor) form of the full-length protein is found in the endoplasmic reticulum. During initial processing in the cell, the about 14 kDa prodomain peptide is autocatalytically cleaved to yield a mature about 60 kDa protein containing the catalytic domain and a C-terminal domain often referred to as the cysteine-histidine rich domain (CHRD). This about 60 kDa form of PCSK9 is secreted from liver cells. The secreted form of PCSK9 appears to be the physiologically active species, although an intracellular functional role of the about 60 kDa form has not been ruled out.

Numerous PCSK9 variants are disclosed and/or claimed in several patent publications including, but not limited to the following: PCT Publication Nos. WO2001031007, WO2001057081, WO2002014358, WO2001098468, WO2002102993, WO2002102994, WO2002046383, WO2002090526, WO2001077137, and WO2001034768; US Publication Nos. US 2004/0009553 and US 2003/0119038, and European Publication Nos. EP 1 440 981, EP 1 067 182, and EP 1 471 152, each of which are incorporated herein by reference.

Several mutant forms of PCSK9 are well characterized, including S 127R, N157K, F216L, R218S, and D374Y, with S 127R, F216L, and D374Y being linked to autosomal dominant hypercholesterolemia (ADH). Benjannet et al. (J. Biol. Chem., 279(47):48865-48875 (2004)) demonstrated that the S 127R and D374Y mutations result in a significant decrease in the level of pro-PCSK9 processed in the ER to form the active secreted zymogen. As a consequence, it is believed that wild-type PCSK9 increases the turnover rate of the LDL receptor causing inhibition of LDL clearance (Maxwell et al, PNAS, 102(6):2069-2074 (2005); Benjannet et al, and Lalanne et al), while PCSK9 autosomal dominant mutations result in increased levels of LDLR, increased clearance of circulating LDL, and a corresponding decrease in plasma cholesterol levels. See, Rashid et al, PNAS, 102(15):5374-5379 (2005); Abifadel et al, 2003 Nature Genetics 34: 154-156; Timms et al, 2004 Hum. Genet. 114:349-353; and Leren, 2004 Clin. Genet. 65:419-422, each of which are incorporated herein by reference.

A later-published study on the S127R mutation of Abifadel et al, reported that patients carrying such a mutation exhibited higher total cholesterol and apoB 100 in the plasma attributed to (1) an overproduction of apoB 100-containing lipoproteins, such as low density lipoprotein (LDL), very low density lipoprotein (VLDL) and intermediate density lipoprotein (IDL), and (2) an associated reduction in clearance or conversion of said lipoproteins. Together, the studies referenced above evidence the fact that PCSK9 plays a role in the regulation of LDL production. Expression or upregulation of PCSK9 is associated with increased plasma levels of LDL cholesterol, and inhibition or the lack of expression of PCSK9 is associated with low LDL cholesterol plasma levels. Significantly, lower levels of LDL cholesterol associated with sequence variations in PCSK9 have conferred protection against coronary heart disease; Cohen et al, 2006 N. Engl. J. Med. 354: 1264-1272.

Lalanne et al. demonstrated that LDL catabolism was impaired and apolipoprotein B-containing lipoprotein synthesis was enhanced in two patients harboring S 127R mutations in PCSK9 (J. Lipid Research, 46: 1312-1319 (2005)). Sun et al. also provided evidence that mutant forms of PCSK9 are also the cause of unusually severe dominant hypercholesterolaemia as a consequence of its effect of increasing apolipoprotein B secretion (Sun et al, Hum. Mol. Genet, 14(9): 1161-1169 (2005)). These results were consistent with earlier results which demonstrated adenovirus-mediated overexpression of PCSK9 in mice results in severe hypercholesteromia due to drastic decreases in the amount of LDL receptor Dubuc et al., Thromb. Vase. Biol., 24: 1454-1459 (2004), in addition to results demonstrating mutant forms of PCSK9 also reduce the level of LDL receptor (Park et al., J. Biol. Chem., 279:50630-50638

(2004). The overexpression of PCSK9 in cell lines, including liver-derived cells, and in livers of mice in vivo, results in a pronounced reduction in LDLR protein levels and LDLR functional activity without changes in LDLR mRNA level (Maxwell et al., Proc. Nat. Amer. Set, 101:7100-7105 (2004); Benjannet S. et al, J. Bio. Chem. 279: 48865-48875 (2004)).

Various therapeutic approaches to the inhibition of PSCK9 have been proposed, including: inhibition of PSCK9 synthesis by gene silencing agents, e.g., RNAi; inhibition of PCSK9 binding to LDLR by monoclonal antibodies, small peptides or adnectins; and inhibition of PCSK9 autocatalytic processing by small molecule inhibitors. These strategies have been described in Hedrick et al., Curr Opin Investig Drugs 2009; 10:938-46; Hooper et al, Expert Opin Biol Ther, 2013; 13:429-35; Rhainds et al, Clin Lipid, 2012; 7:621-40; Seidah et al., Expert Opin Ther Targets 2009; 13:19-28; and Seidah et al, Nat Rev Drug Discov 2012; 11:367-83, each of which are incorporated herein by reference.

In some embodiments, the loss of function mutation induced in PCSK9 e.g., G106R, L253F, A443T, R93C, etc. In some embodiments, the loss-of-function mutation is engineered (i.e., not naturally occurring), e.g., G24D, S47F, R46H, S 153N, H193Y, etc.

PCSK9 variants that can be useful in the present disclosure are loss-of-function variants that may boost LDL receptor-mediated clearance of LDL cholesterol, alone or in combination with other genes involved in the pathway, e.g., APOC3, LDL-R, or Idol. In some embodiments, the PCSK9 loss-of-function variants produced using the methods of the present disclosure express efficiently in a cell. In some embodiments, the PCKS9 loss-of-function variants produced using the methods of the present disclosure is activated and exported to engage the clathrin-coated pits from unmodified cells in a paracrine mechanism, thus competing with the wild-type PCSK9 protein. In some embodiments, the PCSK9 loss-of-function variant comprises mutations in residues in the LDL-R bonding region that make direct contact with the LDL-R protein. In some embodiments, the residues in the LDL-R bonding region that make direct contact with the LDL-R protein are selected from the group consisting of R194, R237, F379, S372, D374, D375, D378, R46, R237, and A443.

As described herein, a loss-of-function PCSK9 variant, may have reduced activity compared to a wild type PCSK9 protein. PCSK9 activity refers to any known biological activity of the PCSK9 protein in the art. For example, in some embodiments, PCSK9 activity refers to its protease activity. In some embodiments, PCSK9 activity refers to its ability to be secreted through the cellular secretory pathway. In some embodiments, PCSK9 activity refers to its ability to act as a protein-binding adaptor in clathrin-coated vesicles. In some embodiments, PCSK9 activity refers to its ability to interact with LDL receptor. In some embodiments, PCSK9 activity refers to its ability to prevent LDL receptor recycling. These examples are not meant to be limiting.

In some embodiments, the activity of a loss-of-function PCSK9 variant may be reduced by at least 20%, at least 30%, at least 40%, at least 50%, at least 60%, at least 70%, at least 80%, at least 90%, at least 99%, or more. In some embodiments, the loss-of-function PCSK9 variant has no more than 50%, no more than 40%, no more than 30%, no more than 20%, no more than 10%, no more than 5%, no more than 1% or less activity compared to a wild type PCSK9 protein. Non-limiting, exemplary assays for determining PCSK9 activity have been described in the art, e.g., in US Patent Application Publication US20120082680, which are incorporated herein by reference.

In some embodiments, cellular PCSK9 activity may be reduced by reducing the level of properly folded and active PCSK9 protein. Introducing destabilizing mutations into the wild type PCSK9 protein may cause misfolding or deactivation of the protein. A PCSK9 variant comprising one or more destabilizing mutations described herein may have reduced activity compared to the wild type PCSK9 protein. For example, the activity of a PCSK9 variant comprising one or more destabilizing mutations described herein may be reduced by at least about 20%, at least about 30%, at least about 40%, at least about 50%, at least about 60%, at least about 70%, at least about 80%, at least about 90%, at least about 95%, at least about 99%, or more.

In some embodiments, the methods and composition disclosed herein reduce or abolish expression of protein encoded by a target gene and/or function thereof. For example, the methods and composition disclosed herein reduces expression and/or function of PCSK9 protein encoded by the PCSK9 gene by at least 3-fold, at least 4-fold, at least 5-fold, at least 6-fold, at least 7-fold, at least 8-fold, at least 9-fold, or at least 10-fold relative to a control.

For example, the methods and composition disclosed herein reduces expression and/or function of APOC3 protein encoded by the APOC3 gene by at least 3-fold, at least 4-fold, at least 5-fold, at least 6-fold, at least 7-fold, at least 8-fold, at least 9-fold, or at least 10-fold relative to a control. For example, the methods and composition disclosed herein reduces expression and/or function of ANGPTL3 protein encoded by the ANGPTL3 gene by at least 3-fold, at least 4-fold, at least 5-fold, at least 6-fold, at least 7-fold, at least 8-fold, at least 9-fold, or at least 10-fold relative to a control.

In some embodiments, the gene modification methods and compositions disclosed herein reduces expression of functional PCSK9 protein encoded by the PCSK9 gene in the cell by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 97%, at least 98%, at least 99%, at least 99.5%, at least 99.9%, or 100%. In some embodiments, the modification reduces expression of functional PCSK9 protein encoded by the PCSK9 gene in the cell by at least 2 fold, at least 3 fold, at least 4 fold, at least 5 fold, at least 10 fold, at least 20 fold, at least 25 fold, at least 30 fold, at least 40 fold, at least 50 fold, at least 60 fold, at least 70 fold, at least 80 fold, at least 90 fold, at least 100 fold, at least 200 fold, at least 300 fold, at least 400 fold, at least 500 fold, at least 600 fold, at least 700 fold, at least 800 fold, at least 900 fold, at least 1000 fold, at least 2000 fold, at least 3000 fold, at least 4000 fold, at least 5000 fold, at least 6000 fold, at least 7000 fold, at least 8000 fold, at least 9000 fold, or at least 10000 fold. In some embodiments, the modification abolishes expression of functional PCSK9 protein encoded by the PCSK9 gene in the cell.

Some aspects of the present disclosure provide strategies of reducing cellular PCSK9 activity via preventing PCSK9 mRNA maturation and production. In some embodiments, such strategies involve alterations of splicing sites in the PCSK9 gene. Altered splicing site may lead to altered splicing and maturation of the PCSK9 mRNA. For example, in some embodiments, an altered splicing site may lead to the skipping of an exon, in turn leading to a truncated protein product or an altered reading frame. In some embodiments, an altered splicing site may lead to translation of an intron sequence and premature translation termination when an in frame stop codon is encountered by the translating ribosome in the intron. In some embodiments, a start codon is edited and protein translation initiates at the next ATG codon, which may not be in the correct coding frame.

The splicing sites typically comprises an intron donor site, a Lariat branch point, and an intron acceptor site. The mechanism of splicing is familiar to those skilled in the art. As a non-limiting example, the intron donor site has a consensus sequence of GGGTRAGT, and the C bases paired with the G bases in the intron donor site consensus sequence may be targeted by the methods and compositions described herein, thereby altering the intron donor site. The Lariat branch point also has consensus sequences, e.g., YTRAC, wherein Y is a pyrimidine and R is a purine. The C base in the Lariat branch point consensus sequence may be targeted by the nucleobase editors described herein, leading to the skipping of the following exon. The intron acceptor site has a consensus sequence of YNCAGG, wherein Y is a pyrimidine and N is any nucleotide. The C base of the consensus sequence of the intron acceptor site, and the C base paired with the G bases in the consensus sequence of the intron acceptor site may be targeted by the nucleobase editors described herein, thereby altering the intron acceptor site, in turn leading the skipping of an exon. As described herein, gene sequence for human PCSK9 is ~22-kb long and contains 12 exons and 11 introns. Each of the exon-intron junction may be altered to disrupt the processing and maturation of the PCSK9 mRNA.

In some embodiments, a splice site disruption generated by a base editor system disclosed herein can result in the inclusion of intronic sequences in messenger RNA (mRNA) encoded by the PCSK9 gene. In some embodiments, the splice site disruption generates a nonsense, frameshift, or an in-frame indel mutation that result in premature stop codons or in insertion/deletion of amino acids that disrupt protein activity. In some embodiments, the splice site disruption generates exclusion of exonic sequences. In some embodiments, the splice site disruption generates exclusion of exonic sequences that results in nonsense, frameshift, or in-frame indel mutations in the PCSK9 transcript. Canonical splice donors comprise the DNA sequence GT on the sense strand, whereas canonical splice acceptors comprise the DNA sequence AG. Alteration of the sequence disrupts normal splicing. Splice donors can be disrupted by adenine base editing of the complementary base in the second position in the antisense strand (GT to GC), and splice acceptors can be disrupted by adenine base editing of the first position in the sense strand (AG to GG).

Further, the present disclosure also contemplates the use of destabilizing mutations to counteract the effect of gain-of-function PCSK9 variant. Gain-of-function PCSK9 variants (e.g., the gain-of-function variants have been described in the art and are found to be associated with hypercholesterolemia (e.g., in Peterson et al., J Lipid Res. 2008 June; 49(6): 1152-1156; Benjannet et al., J Biol Chem. 2012 Sep. 28; 287(40):33745-55; Abifadel et al, Atherosclerosis. 2012 August; 223(2):394-400; and Cameron et al, Hum. Mol. Genet. (1 May 2006) 15(9): 1551-1558, each of which is incorporated herein by reference). Introducing destabilizing mutations into these gain-of-function PCSK9 variants may cause misfolding and deactivation of these gain-of-function variants, thereby counteracting the hyper-activity caused by the gain-of-function mutation. Further, gain-of-function mutations in several other key factors in the LDL-R mediated cholesterol clearance pathway, e.g., LDL-R, APOB, or APOC, have also been described in the art. Thus, making destabilizing mutations in these factors to counteract the deleterious effect of the gain-of-function mutation using the compositions and methods described herein, is also within the scope of the present disclosure. As such, the present disclosure further provides mutations that cause misfolding of PCSK9 protein or structurally destabilization of PCSK9 protein.

The polypeptide and coding nucleic acid sequences of PCSK9 and of other members of the family of human origin and those of a number of animals are publicly available, e.g., from the NCBI website or ENSEMBL website. Examples include, but are not limited to the following sequences, each of which sequences are incorporated herein in their entireties; Wild Type PCSK9 Gene (NG 009061.1), *Homo sapiens* proprotein convertase subtilisin/kexin type 9 (PCSK9), RefSeqGene (LRG_275) on chromosome 1

(SEQ ID NO: 5)
```
GTCCGATGGGGCTCTGGTGGCGTGATCTGCGCGCCCCAGGCGTCAAGCACCCAC

ACCCTAGAAGGTTTCCGCAGCGACGTCGAGGCGCTCATGGTTGCAGGCGGGCGC

CGCCGTTCAGTTCAGGGTCTGAGCCTGGAGGAGTGAGCCAGGCAGTGAGACTGG

CTCGGGCGGGCCGGGACGCGTCGTTGCAGCAGCGGCTCCCAGCTCCCAGCCAGG

ATTCCGCGCGCCCCTTCACGCGCCCTGCTCCTGAACTTCAGCTCCTGCACAGTCCT

CCCCACCGCAAGGCTCAAGGCGCCGCCGGCGTGGACCGCGCACGGCCTCTAGGT

CTCCTCGCCAGGACAGCAACCTCTCCCCTGGCCCTCATGGGCACCGTCAGCTCCA

GGCGGTCCTGGTGGCCGCTGCCACTGCTGCTGCTGCTGCTGCTCCTGGGTCC

CGCGGGCGCCCGTGCGCAGGAGGACGAGGACGGCGACTACGAGGAGCTGGTGC

TAGCCTTGCGTTCCGAGGAGGACGGCCTGGCCGAAGCACCCGAGCACGGAACCA

CAGCCACCTTCCACCGCTGCGCCAAGGTGCGGGTGTAGGGATGGGAGGCCGGGG

CGAACCCGCAGCCGGGACGGTGCGGTGCTGTTTCCTCTCGGGCCTCAGTTTCCCC

CCATGTAAGAGAGGAAGTGGAGTGCAGGTCGCCGAGGGCTCTTCGCTTGGCACG

ATCTTGGGGACTGCAGGCAAGGCGGCGGGGGAGGACGGGTAGTGGGGAGCACG
```

-continued

```
GTGGAGAGCGGGGACGGCCGGCTCTTTGGGGACTTGCTGGGGCGTGCGGCTGCG

CTATTCAGTGGGAAGGTTCGCGGGGTTGGGAGACCCGGAGGCCGAGGAAGGGCG

AGCAGAGCACTGCCAGGATATCCTGCCCAGATTTCCCAGTTTCTGCCTCGCCGCG

GCACAGGTGGGTGAAGGAGTGAATGCCTGGAACGTACTGGGAACTGCACCAGGC

ACAGAGAAAGCGGGCTTGCCATTATAGTGGGTTCCGATTTGGTTTGGAAAACATG

GGCAGCGGAGGGTGGAGGGCCTGGAGAGAAGGCCCTACCCGAGACAGGGGCGG

GGTGGGAAGGACGGCAGATGCTGGGAGCACGAGGCAATTTCTTTATGACACAGA

ACTCATGCTCTAGTATTCCATCTGTTTCAGCCGAAGAAAAGAACCAGCTGAAGGG

GCAGGGGAGAAGGGGCGGAGGTATTCTCGAGGCCCATTGGCGTCCTTTAGGACT

CAGGCAGGGAAGGGCCCTTGGTGCTCTGGAGCCGGAGGTGGTGCGCCTGGTACT

GGGACCCCGGAGCTGAGCCCGGCGCCTCAGCCCACCTGGCTGTCTGCCGACCGT

GTGCGGGGCGAGTTTGCTCAACAACTCTGCCAGCTTCTGGCCCTCAGGCTGTGGG

AAGCTTCTTCCCGGGGCGAGACCACTAGCTTTTTCTAAGTATTACCAGCCCAGGA

CTTGGCTGAGGTTCTGTGTCCCCCAGCTTGGAGTCAGATGTGGGGTTGAATCTTG

GCTTCCTCTCACTAGCTGTGGTGCTTGACAAGTCACTTATCCTTGAGCCTCCATTG

CCTAATCTTTAAAAGGGAGGTGACAATCGTCCCTACGGCTCAGTGGCAGCAGAT

GGGGAGATGAAGGGAAAGTTCTGTTGACCATGAGTGAACTTACAATGCAAGCCC

CGGGGGGATCACTTGCAGTTTTGTCCCTGTCTGCAGTGTGACCTGTTGGTGACAT

TGTCTTTGCTCCAAACCACAGCTCCTGGGGCAGAGGGGAAAATTCTGCCACTCAC

AGCTGCCTGCCCACGCTTCTGTCTGAGTGTGCTGGGTGGCAGGATGGCAAGTCCT

TACTCAGCTCAGTATAGCCCTCTTCCTTGTTCCCTGAGCCTTTGACTTTCTCGAGG

GATGTTGTGGGTTGTGGCCAGGATAAGAAAGGGCATTTCAAGTTACCACTGCTC

CAAAACAACTGTTCTGGAAATAGTGAGTACCCCATCCTGAGAGGTGAGTAAGCA

GAGGCTGTATGACCACCTGAACCAAGCCCTTGAGGATGTTTCTTCTCTGGTGGAA

GTTTGGAACAGGAGCCTCCTCAAGTTCATTTATTCATTCATTCAATGGTTATTTTG

TGGGAATCGAATTTAGAATGAAAATATTTTTTGGCAAGCAGAAAATAATTTTTAG

ACCAATCCTTTTCTTTTAGTCATGAGAAACTGAGGCCCAGAGAGAGGAGGTCACC

CCAGGTGCATTAGAACTGGGTTTCCAGAACTGACACTCCACTGCACAGAGTACTC

TCCCAATTCATTCAATTTTTATTTAGCGGAAGGCATTTTCAGATGGGTCTTTGAAG

CATTAGTAGGAGTTCAGCGATGATGGTGTCATGAGAATTTTATTCTAGGATTAGG

AGGTACCATGAACAAAGATACAGAGCTGGGAAAACCAGAGGTGGAAGATAAGG

AGCACATGTCCACAGTTCTTTTCTTTTTTTTTGAGATGGAGTTTCGCTCTTGTTG

CCCAGGCTGGAGTGCAATGGTGCAGTCTCAGCTCACTGCAACATCTGTCTCCCGG

GTTCAAGTGGTTCTCCTGCCTCAGCCTCCCAAGAAGCTGGGATTACAGGTACCTG

CCACCACGCCCGGCTAATTTTTGTATTTTTAGTAGAGAAGGGGTTTCACCACGTT

GGCCAGGCTAGTCGCAAACTCCTGACCTCCTCAGTGGATCCGAGGAGGTGATCCT

CCCGCCTCAGCCTCCCAAAGTGCTCGAATTACAGGTGTGAGCCACCACGCCTGGC

CTCCACAGTTCTTTATCCACCGTCTGAAATGTAAAATGTTACGAAAACCAAAAGT

TTTTTTTGTGATTTATTTGATGGTAGCACCTGACGTGAACTGACATGAGATTATTT

TTAATTTAGTTGTGTGAATATGCATATTCATATATTTTGCTGCATAGATTACAGTA

TGCAGCTCCAGATTCTTCCAAGCAGACTCTGATTGCCCATTACTGCCTTTCTAAA
```

-continued

```
ATCCAAACAAGTTCTGAGGTTCAAAACCGTTTTGGCCCTAAGGCTTTGGGTAAAG

GGGGTGGACTCTGTTCTACTCTGACTGGAGTCCAAGATGCATATATACAGAGATA

TGGGTGATGGGGCTGCAAGGTAGGTTGAGGTAGGGGCCAAGGAGGAGCATGGA

GTTTGGACTTGATTCATGAGGCTGTGGGGAGCCAGTGAAGGTTCTTAAGCAGGTA

TGTCTGCCTGAGAGCAGTTGGAGCAGACAAGAGCTAAAAACCAAACAAATCACC

ATAGATAGTGGCTGCTATAATTTGTTTGTCCCCTCCAAATCTCATGTGGAAATTTG

GTCCTCAGTGTTGGAAGTGGGGCCTAATGGGAGGTGTTTGGGTCATGGGGAGG

AACCCCTGTGAAAGGCTTGGTGCCGTCCTTGTGATAATGAGTAAGTTCTCCCGCT

ATGATTTCCCTTGAAGGCTGATTATTAAAAAGAGCTTGGCACCTCCCTCTCTTCTC

TCTTGCTTCTTCTCTTGCCATGTGATTGATCTCTGCACATGTAGGCTCCCCTTCAC

CTTCTGCCATCAGTGAAAGCAGCTTAAGGCCCTCACCAGAAGCAGATGCTGGTG

CCATGCTTCCTGGAGAGCTTGCAGAATCATGAGCTGAATAAATCCCTTTTCCTTG

TAAATTACTCACCTTCAGGTATTCCTTTATATAGCAACACAAAAGGACTAAGACA

GTGGCCTTGACTTTTCTCTCTCTTTAAGAAGTGTTGCCTTTGCTCACTTAGTCATC

CCTTCTGCCTGCATTTGTAGAGCATCTGGATGGGAGATTTATATAACCGTCACTC

TTGACTTTCCCAGCAGGCCTATGTCATAGGTACTGTGGTCTCTACAATACAGCAG

AGGTATCTGAGGCTCCGAGAGGTTGAGTGACTTGCTCATGGCTGCACAACCAGT

AAATATTGGAGCTGGAATTCAGGTCCACGGTTTCCTGGCTCCAAAGCCCATGATT

TTTTCCCTCAATTTATTCTGACTGGGGCATGGGGAGGGGTGGCCTTTGGGCAG

GGCCACCAGGAGCGACCAGGCCCGTAGAGAGCTGGGTGCAGGTACAGAGGAAA

ACCTGTTGTCGAGTGTGGCCCGTAGTTCCCATTTTTGCCTGAATGGCACATTTGA

AAGTGTTATATAACCATGTGAATAATAATAGTTGGCCTATATGAGTTCTTTAATTT

GCTTTTTGGTCCGCATTTGGTAACTTCTTTATCATCTACTATACTCTGTTGTGTCTC

TTTTGTTGTAATTTGTAAGTAGGGGTGAGATAAAGTACACCTAGGGTTTGCTGGG

TTTCTTCCATGTCATCATGTTCCTCCTTGCATGGGGCCAGGATCCGTGGAGGTTGC

CTGGCACCTACGTGGTGGTGCTGAAGGAGGAGACCCACCTCTCGCAGTCAGAGC

GCACTGCCCGCCGCCTGCAGGCCCAGGCTGCCCGCCGGGGATACCTCACCAAGA

TCCTGCATGTCTTCCATGGCCTTCTTCCTGGCTTCCTGGTGAAGATGAGTGGCGAC

CTGCTGGAGCTGGTGAGCCACCCTTTTTGGGAATGGCACTTCCTGATAGGGCTGG

GCCACTGCATATACACTGGGGACTGTGCTTAGTAGGCCCATTGCTGAAAATCAGA

AGGGGACAGCAAGTATGTATTGAGCACTTATCGGGTACCAAGCACAGTAACTAC

TGGCTTTCTGTATAGAATTCCCTTTAAGCCTGGCCATGCCCCAGTGGTACGTCTAT

CTTCATTTGAAAGACGAGGAGACTGAAGTTCAGAGGGGACCACACAGACAGCTA

GGGGTAGAGCCTGGATCAAACCCATTGGTCTGCCTGCCAGCCATTCTTGTGCCAA

TGCATCTGCTGCCTACGGAAACCTGTAGGGACAAGGCCCTGGGATGTTCAGTGG

AGCCTGAGTCATTTTATAAAAAAGCATGACTCTAGGGTCCAAAATTCCTTTGAAG

CTGTTGCTATCCAGAGTGAAGTCCCTTCTTTAGGACAGGGTGGCCCTCCTCCCTC

CTGGATGTCACATCTTCGGTGGAGGGGCAGAAAGGGGACTGGGTATTCTCCTCA

CCCTGGCCCTAGTGCTTCAAATCTTAAAAAAACGTTTTTATTTGTGCTTCTGCACC

ACCTTCTAGCCCACCTCGTTTCCTGGCCTCTAACTTGATGAGAGCGTGTGTCATTT
```

-continued

```
TCACACTGATTCTCCACATGGCAGGCGGTGCTTCTTAGCCTCCTGCAGACAGTGA
GGCCCCACGGTCTTGTCCAAGGTCACACAGCGTGTAATGGGCAGGGTCAGAGTC
TGGAGTCTGGACCTGGGTCTCCTAGCTGCACTGCACTGCTGCCCCATGGGTTAAT
CAGCTCAGCATACCGTGGCTGAACAGCTACCTCATACCAAGGCCTGTGGCGCCAT
GACAGGGATTGACAGGGTCCCTGCCTTGGAAACCCGTAGTCTAAGTAGAGGAGA
CTGACAAGTCAATGCCTTCCATCAGTCTGCTCAACACACGTTTACCAAGTGCCTA
CTGTGTGCTGCAGAGGCGAAGATGACACAGCTCAGGCCTTTCCCTTGAGCTTACA
GTTCAGGAGGAGAGACTGACCAGTGACTGCCAGTACAGTTGACTATGGGACAAT
GTGCTCAGCCTTGGGGAGAGACGAAGAAGGTACCCGTATAGCACCAGATGACAG
GCACGAGCCCCACAGGCCAGGGCAGCTGCTCAGAGGAGAGTAGGCCAAGCAGA
AGGCAAACAGAAGGCTGCAGGCATTTGCCATCGAGAGCTGGACTTCAAACTGGG
CATCATACCAGCCTGGGTTCGAGTCCTGCCCAGCCCCTTATTGGCTGTCTAACCC
TGAGCAAATCCCTTCACCTCTCTGAGCCTCATTCCTCTATCTGTAAACCAGTTATA
ATAATTGGAACATTCATTTAAGGACTAAATGAGGTCGTGAAGCATTCAGCAGAT
GCTAGGTACGGAAACTCGCTGAAGTGGGGGCAGGTTAAGAAGCCTCTGGGGATA
CGAAGGCATCCAGGGACTAGTTGTGGCAGGAGGCTGTTACCACTTAGGTCTGAA
GGGTAAGGAGAGGGAATAGCTTTCCCTCTGCCCAGTTGGAGCCGGTGGCATGGA
GGAGAGGCTGCCTGTGGGAATCACCCGAGGGTTCACCGCTGCCATGCGCAGGG
AGTCAGGAGGTAGGGAGGGAGTGGGGCAGATGCACACCATTTTTTTTTTTTTG
AGACTCTGTTGCCCAGACTGGAGTGCAGTGGTGCCATATCTGCACCTCTGCCTCC
CGGGTTCAAGCTCACTGCAACCTCTGCCTCCCGGGTTCAAGCGATTCTCCTGCCT
CAGCCTCCCGAGTAGCTGGGACTACAGGTGTGTGCCACCATGCCTGGCTAATTTT
TGTATTTTTAATAGAGATGGGGTTTCACCATGTTGGCCAGGCTGGTCTCGAACTC
TCGACCTCAGGTGATCCCCCACCTCGGCCTCCCAAAGTGCTGGGATTACAGGCGT
GAGTCACCGCTCCCAGCTGCTGATGCACTCTTGTCCTTCTAACTCCTGCTAGTGCC
TCCCATTGGCTGAGCCCAACTGGAAGCTTTGCAAGGGAGCTGGTGCTGCAGTTTG
CACTGAGCAGGCTGGAGAAGGCTGGAGAATAGACTAGGGGACAAACCGAATTG
CCAGTGCTGTTATGTCATGATTTAGGCATGGAGTCCAGGGCCTGAGCTTCACTCC
ATGTCCATCCTGCCCAGAGCCTTGGCACAGCCTGGCTCCCAGACAAGATGTCAAG
TTCAGAATCCTTCCTAAAAGGAATCCTCTATGCCAGACCGTGTTGCAGGGATATG
GGAGTGCTGGGCTCCCAGCCTGATCAAGGAGCGAGAAAACTCAGGCTCCTAGTC
TGTCCTCCGGGGCACTAGCAGGGACAAGGTGGGAGGCTGCTGGGCTGGGATGTG
GGGACAGGTTTGATCAGGTAAGGCCAGGCTGTGGCTGTGTTTGCTGCTGTCCAAA
TGGCTTAAGCAGAGTCCCCCGGCCTCTCTGGCTTCTGCAGGCCTTGAAGTTGCCC
CATGTCGACTACATCGAGGAGGACTCCTCTGTCTTTGCCCAGAGCATCCCGTGGA
ACCTGGAGCGGATTACCCCTCCACGGTACCGGGCGGATGAATACCAGCCCCCCG
GTAAGACCCCCATCTGTGCCCTGCCCCACCCCATCTGAGCTGAATCCATTTGCTC
TGCCCTGGCCTGGCCTCCCTGCTGGTGGTTTCCACTTCTCGGGGGGCTTTGGGACT
CAGCACCTCCACTGACCCCTTTTTTTCTGTCCCATCCCCATCCCCTGCAGCCCCCA
CTGCCTGCCTTCCTGTTGCCCCACAAATGCAAAAGTCTTGCCTTAAATGATCCTCT
TTTCCTTCTTTTCTCTTGTTTTCCTTTTCTCACCATTTGGAATGGCCCAGCAGGCTG
```

-continued

```
CACTTACCTTGGAAGGAGGGTTCATCTGATGGTGACTCTACCTAGGGCCCCCAGG

CCTCTATAACTCCCAGTGCCCTGCAGACTGGACCAGATCCTTTAATGGGATAGAC

ACAACCCTGTCTGGGATGCCTCTGCCTACCTTCCTGTTTTGCTGCTCCACCTGCCT

CCAGCTCCGTTTGGCTTCCTGGGGCTCCCTGCCTGGGCCACTTTGTGTCTTCCCTC

TAGGCCTTTCTTTCCACTGTTCCCTCTGCCTGGTGTGGCCTGGCTATGGAAGGGA

GGGAGGAGGAGCGGCCATGGAAAACGGTCTGCATTCTAGCAGGGACTTGCAGGT

GGCAATTCAGTCGGGGAAGACTCTAGATGCACCTGGCCTGAGGAGAGAATGAAG

GGTTCTAGTTGGACTGTGTTAAGTTTGAGGTGCCCATGGTGTGAGGTCTGGAGCT

CAGCGCAGAGATGATGCAATGTGGTGGGTCCATGCAACATGGTGCCAGGACGCA

GAGCTTGGGGTGAACTCAGCTTTCACCCCTTACCGGTTCTCGTGGGATCTTGGGA

AGCCACTTTCTTCTATGAGCTTTGTCGTTCTTGTCTGTAAAATGGGCACATAACCC

TGTCCCTGTCCTTCTCACAGGTTGCTGTGAGACTCCAATGAGTTGAAGGATGTGC

AGATGCTTTTGGAAGTGAAAAGTTGGGGGGCTACTGTGTGACTTTGCATACACCC

AAACTGTGTGACCTTGCATATGTCTGAGTTGCTGCCATTGCAACAGATCAGAGCT

GGTGGGCTGGGTGTGGAGAAAGGGTTTGTGTGGGGGACATCCTCTGGCAAGGGT

GGCAGCAGCAGAAGTGAGGGGCCTGGTCGGTCATGTGTGCTGACCCGGCCTGGG

CAGCCTGTGGCCAGGGAGAGGACAGCTCCTCTGTAGGAAGAGCCTGTTCCTTTCC

AACCAGGTGAGACCTCTTCAGTGGAGCCCTGGAGCCCCCTGTACTCCACATCAGT

GCCTCAGGGACCTCCCGGAGCAGGCTAATATCAGAGACCAAGAGGGACACTGGC

AGAGGATCACAGAGACCCCAGTCCAGGCAGGGACTGAGAAGATCTTGCCCCCTA

AGTTAGTTTCCTAGCACTGCTGTGACAAATTACCACCCCCTCGGTTGGAACAAGT

TGATTCTCTGCAGTCCTGGAGGCCAGAAGCCTGAATCAGTGTCGGCAGGACCACT

TTCTCCCGGGGGGCTCCAGGGAGAAGCTTCTCTTGCCTCTTCCGTGTCCCAACAG

CGGCAGCACACCAATCCCAGCCTCTGTCTTCACACAGCCTTCTCTGTGTCTCTCTC

CTCTTCATTGTCTCATAAGGACACTTGTCATTGGATTTAGGGCCCACTGGATCCTC

CAGGATGATCTCATGTGGGGAACCTTAACCACATCTGCAAGGACCCTTTTTCCAA

ATAAGGTCACAGCCACAGGTTGTGGGGGTTAGGATGTGAGTGTATCTCTTTGGCA

GCCACTGTTCCCTCCTCTCCCTTGGGCCAGAAGCAGACGTGGGGCCCTTTCTTCC

CCATAGGATGCCCATGGATTGCCCCCCTTCCCGCTTCCCCCGAGTGTCTGTGGGA

GGTGGCAGGAATGGCAGGCAGGGGTGTGGAACCCCTTCTGGAGTCATATCAAGG

GCTTGGCTGGAGGAAGTCCTCCTGGAGCTGTTGGGCTGGCATGGGGCAGGCTGG

CTGGGCCCAGCAGCAGCTTCTTCATTCATGGGGAGGCCACAAGCATGGGCCCTA

GAGCTGGCTGCCGCCCTCAAACCCAGACCCTGCACTCTTAACTGTGTGACCTTGC

ATACGTCACTCACCCTCTCTGATCTTCAGGTTCCTCTGCAAAAGGGAGGTAATGA

TAACCCTCACTCTGGGGGGCTGTTTGGAGGGTTAAATCAGTTATTGCTGTAGCAT

GCATTTCTCTGTCAGGTATTGAGTGAGGTGCTGTGATTTTAGCCCTGCATTTTTCT

TTTCTTACCATTCAATAATAACGTTTTGAGCACCCACTGTGCGCCAGGCACCATA

TTAGGTGCTGGGGATACAAATGTGAATGAAATGAATGTGGTCTCTTCCCCCAACA

GTGTATCCAGAAGATTAATCCATTCCTTAAACAAATGCTACTTGACACAGATTAG

TTCTGGATAGGCTGAGAGCTCTGAAGGAGTGCAGGCAGCTGCGAGCCTGTGTAT
```

-continued

```
CCAGCAGAAGGATCAGGAAAGGATTCCTGGAGGAAGCGCTGTTCTAGCCAAGAC
CTACGGGGCATTATTAACCAGGCAAAGGGGACGGTGTCCAAGCAGTGGAATGA
ACGTGGATTGAAGCTGTGAGGCAGGAGGGAGTGTGGCCTGTGCAGAAGGGACCG
AGGCTGGTGAGACCAGGAGGGCCTGGGTGGCCTCCAGGTCAGATGTGAAAGGAA
GAACTTGGCCACAGTCTGAGCTTCTCAGGCGTATGGCAGGGCTGCCTGGTGAGA
GGGAATGAGCTCCCTGCTCTGGAGGTATGCAAGCAGGACTGGGCTCTCACCTGC
CAGAGGCCACAGAGCTTTCCAGAGGCTGGAAGAGGCCACTCCAAGGCCTCTTTG
CCCCTGAGAGTGGTGGCTCTTCTTGAGGCCACCTTGCCACGCTGTCACAGGGAAC
TAGCAGCCCCTGCCTCACCCGGGGGTTTGGAAGATAGAGGGAGGCCTAGGAAGG
GCCCTGTGTCTCATCCGAGCTGGGCCCCTTTCCAGCCTCTCACTGGAAGGAAGCC
CAAGGATGTTCCTGTGGGGGCTTTTACCAGGCCCACCTGCCCTCTGCTGGCCATG
CTTGCAGCCTCCTGACCCTGTCCCAGCAGGACAGTGGGCTGGTGTGAGCGGGCA
GGAACCGCCTGCACTTAGAAGGTGTGGGGCTGCCTCCCCGAGCTTCCATCTGCCG
CTGGGGCCACACCCCAGGCCCAGGGATGGGACCCCACAGTGGTCACATCATCTT
GCAGCAGAACCCAGGTACAGCTCCTGGAGCAGATGGTGGTCCCAAGCACGGGTG
GGACCAGAAAGGACTCTCACCTGGGCTAACTCAGCTGCAGCCTCAGTTCCCTCCT
CACACACGACGAGGAACATGGACTGGAAGCCTGCCCAGCAGGCCTTCTGCTCGA
TGTGCGTTGTGTGGCTTACGTCCAGGGAGGGAAGCAGCCTCTGTGCTGTCTTCTA
GATAAGCCTGTATTCCCCGGGCTGTCTGCCAATGTATCCAGTTGTCCCGTCAGCC
TGGAAGCTCTGAGGGAAAACCTTGGGCTGCTTCCTGAGCACCTGTATCCCCTGCA
GCCAGCCCGGGGCCTCTGCTAGGAGCAGACTGAGCATGGCTTATGGGCCTGGCA
CCATCTGGCCTCTGCCCACCTTGCTGGCCTTGTCTTGTGTCTGCCCCTTCGACATT
CCATAGCCCAGCTCAATATCTAGTGGTTCCTCTAGGGTGGCGAGCACTGTTTGGT
CTCCAGATGTCTTCAGGTCGGAGCTCACAGCGCTCTCAGCCACCCCTTCCCAGTG
TAGCACCGGGCACATGGTAGATGCCTATTGATGAGTGAAAGCTCCTAACACACT
CAGAGAGCAAGGACTCCGCCTCATCCCACAGCCTGGGAGGAGAGGCAGACTGCC
AAGGACCTGCTCAGCATGCTACAGAAGAAACCAAAGTGCCCACGGGACTGATCA
GTGGAGCTTCCTGCCGAGACTGGAGGCCTTAGGGCAGGGTAGACAGTGTGTGTG
CAGGCTGGGGACTCACAGTTCGGACTGTGCCCAGACCTACTAGCATAGTGGGTG
GGTGGGAGGATGCGGGACTGGGGGCCGACCTTGCCTGAAATTCATGTGGGATCT
CAGAGCAGCCACTGAATTGCTCTGTAGGGGGCTAAATAGTGGCCCCCACAGATA
CACACACCCAGACAGAGCCTGTGAGCCAGACCTTATTTGGAGAAAAGGTCTTTG
TAGATGTAATTAAGCATCTCAAGATGGCATCATCTGGATTATGCGGTGGGCTGTA
AGTCCTGTGATGTGTCTTTATGAGAGAAAGGCAGAGGGAGATTTGACACACACA
GGAGGGGCCACGTGGAGACAGAGGTGGAGATTGGAGAAATGTGGCCACAAGCC
AGGGAACACCAGCAGCCACCAGAAGCCGGAAGACGTGAGGCAGGGTTCTTCCCA
GAGCCTTCGCTGCTGAGTCTGGGAATTTGTGACCGAAGCCATAAGAAGTGGGTA
CACGCCCTGAGCCTCCCACACTTGCTCACCTGTCCTGAGATGAGAATCTCTACTC
TGCAGCATATTTGGAGGATCACTGCGGGGCCACAGAGGTGCTGTTCAGATGGC
ACTTCAGAAGACTCAGGAGACCCTGGGGCAGGAGCAGTTTGACTGACAGCCCAG
AGGGCTGCCCTCTGATTCCACCTGAGGCCCTGCTTTTCCTGGCTGCAGGGGTTCC
```

-continued

```
AGGGCCAGGCCATTTCCGCTGGCGCAGGACTCTGCTAGCAGCAACCTGCCTGAA

GTCTTCCTTTGGCCTGGCTGAGAGTTTCTGAGACCTGCGCTGGAGCGGAGGTGCT

TCCTTCCTTGCTTCCTTTCTTCCTCTCTCCCTTCTCCATCCAGCAGGCTGGACCTGC

CTGGCATCTGTGAGCTCTCCCTACTTTCTCCTATACCCTAACCTTTGTCCTGCATG

GGCGACTCCCCCAGTGAGTCTCTTGCAGCTTTTACCCCAGTGCCTGCTTCTTGGA

GAATCCAAACTGATCCAGTTAGGGATGATAAAGTGTAGGGTAGGCGCTCGGTGA

CTGTTTTCTCTGAGGTTGTGACTCGTGTGAGGCAGAAGCAGTCCCCGTGAGCCCT

CCTGGTATCTTGTGGAGTGGAGAACGCTTGGACCTGGAGCCAGGAGGCCCAGAC

ATACATCCTGTCCGAGCTGCAGCTTCCTGTCTCTAAAATGAGCCGGCCAGCGCAG

GTGGCCAGACATCACTGTTATTCTCCTTTGAGTCTTTAAATCTTGTTGTCTTTCTTG

CAGACTCGGTGAGCTGTGAAAGGCTATAATAGGGGCTTTATTTTACACTTTGATA

CTATTTTTTGAACATTCATATTATTGTTAGATATTGATATTCATATGAAGGAGCAG

GATGACTTGGGTCCTTCTTGGCAGTAGCATTGCCAGCTGATGGCCTTGGACAGTT

ACCTGCCCTCTCTAGGCCTCCCTTTCCTTGTCTATGAAATACATTATAGAATAGGA

TGTAGTGTGTGAGGATTTTTTGGAGGTTAAACGAGTGAATATATTTAAGGCGCTT

TCACCAGTGCCTGGGATGTGCTCTGTAGTTTCTGTGTGTTAACTATAAGGTTGACT

TTATGCTCATTCCCTCCTCTCCCACAAATGTCGCCTTGGAAAGACGGAGGCAGCC

TGGTGGAGGTGTATCTCCTAGACACCAGCATACAGAGTGACCACCGGGAAATCG

AGGGCAGGGTCATGGTCACCGACTTCGAGAATGTGCCCGAGGAGGACGGGACCC

GCTTCCACAGACAGGTAAGCACGGCCGTCTGATGGGAGGGCTGCCTCTGCCCAT

ATCCCCATCCTGGAGGTGGGTGGGGACTGCCACCCCAGAGCGTTGCAGCTGTACT

CCTGGGTTGCACCCCCCCCAGCTGTCACTGTCCCCTCCCTGCCATCAGTTGTGGG

AAGGGCGTTCATCCATCCAGCCACCTGCTGATTTGTTATAGGGTGGAGGGGGGT

CTTTCTCATGTGGTCCTTGTGTTCGTCGAGCAGGCCAGCAAGTGTGACAGTCATG

GCACCCACCTGGCAGGGGTGGTCAGCGGCCGGGATGCCGGCGTGGCCAAGGGTG

CCAGCATGCGCAGCCTGCGCGTGCTCAACTGCCAAGGGAAGGGCACGGTTAGCG

GCACCCTCATAGGTAAGTGATGGCCCCAGACGCTGGTCTCTCTCCATCTGGACCT

GGCCTGGGAGGTGGCTTGGGCTGGGCCCAGGGAGAGCTAATGTCTCCTAACCAA

GAATGCTGTGGCAGCCTCTGCCGCAGAGCCAGAGAACCAGAGTGCCAAGGCTGG

CAGGGTTCCCAGTGGCCACGAGTGCAGATGAAGAAACCCAGGCCCCAAGAGGGT

CATGCAGGTAGCCCAGGGAGTTCAGCCTTGACCCTGGGTCAATGACCTTTCCACA

GTTCCACACTGCTCCCCTTTTAAAATCCGGTGATGTCTTTATGTCTTTTGTTATGTT

ATCTTCAATGTGGAGGGACTCGAGGTGATCTAAGCAAACTTTTTCTATCTTCTGCT

TGCATACCTCTGAGACCAGGGGACTCACTCACTTGCATGACTGGGCCCTGCAGGT

CACACTGGCCAGGCAGATGTGGTGGAGGAACTGGCAGAGGACTTTTTCTAGACT

GTGACTACATTTAGTCCACCCAGCGGCCCCCCTATGAAGTCCAGTTGAGAACTAG

GACTCTGGGGGCCGGTGGACAGAGAAGAGGGAGGGTTCTCTCCCTTACTGACTT

CCTTCTGTGGCCAGACATTGAGCAAGGCCTCTGTACAGCATGTCCTGGGGCTGGC

CTTGCCGTAGCTGCTAAATAGTTGACGAAACCAGTCCAGAGAGGGGAGGTGACT

GCCAGGGTCGCACAGCTCAAGCTGGGGAACTCGCTGGGAAAACTGTCAGCTCTG
```

-continued

```
GGCAGCAGCTTGACTTCCACTGTAAGCCCCAGCCCCCAGGGTCAAACACTGGCTC

TGGTGCTGGCAGAGGCAGCCCACTAGCCTGTTTCAAAGGCTGAGAAGGCCCAGG

AGTCTGCCCTGTGCTCCACCAGTTCTGCCCTGAGACTTTCCTACAGAGTACAGGT

TTTGATGTTCAGTTTTAAAGGCAAGAATCAATAACCTTCTGCCCCATCAGGTGAC

CCCTTGTGCCTGTCCCACCCCTTTATTGACTGACCTCGGCTCAGTCAGGTCAGTTC

CTGAAGGTCAGTGTGTGGAGGGGAGGCTGTTCTTTCCCAGAAAGGCCTTCCCCAG

GCCTGGTGCTCTGGCCTCTGGAGGACTTCCTGGAGAAGTCCCTTCTTTGGGGTCC

CAGTCAGTGTATGGGAAGCCCTTATTGCATGACCTGGCACGGGGCAGGGGCTCA

ACAGTCACTATTGCCTTCCTTGCCACTGCCATTTCCTCCTCTGTAAGCAGGTGATT

GTGTGTCCAGTCTGAGCACAGAGATAAGCACACAGCAGGTGCTTAATAACTAGC

AGCTGTAGGCTGGGCGCGGTGGCTCATGCCTGTAATCCCAGCACTTTGGGAGGCC

GAGGTGGGCAGATCACCTGAGGTCAGGAGTTCGAGACCAGCCTGTTCAACATGG

TGAAACCCCGTCTCTACTAAAAATACAAAAATTAGCCAGGCATGGTGGTGGGTG

TCTGTATCCCAGCTACTTGGGAGGCTAAGGCAGGAGAATCGCTTGAACCCAGGA

GGTGGAGGTTGCAGTGAGCTGAGATCGTGCCACTGCAATCCAGCCTGAGTGATA

GAGCGAGATTCCATCTCAAAAATAAATAAGTAAATAACTAGCAGCTGTAAATGT

GGCTGTTGTTCTTCACCTCCACACTCAGTGCCACTCCACTCCCTCCCTCCGTGGTG

TGAGGGGCCTCACTAGCTGTCTCCTAGGAGGAGCATGGCTGTGAGATTCCAGCTC

CATCCTTGGCCACGGCTCCTGGAGACATCTTAGAGGCCAGGATCCAGAAGGCTC

CCACACCTCATTTGACAGGGGAGAAGCTGTCAGTTCCAGGTCCCCTTGCACATCA

GGGCCAGAGCTGCGTTAGGCCTCCAGTCTCCAGGCCACTGGGCCAGAGCTCACA

GGCTGGCAGAGGGTTAGAACTGTTACTGGTGGCTGGGTGCAGTGGCTCACGCCT

GTAATCTTAGCACTTTGGGAGGGCAAGGCGGGAGGATCATGAGGTCAGGACATC

GAGACCATCCTTGCTAACACGGTGAAGCCCCGTCTCTACTAAAACTACAAAAAA

TTAGCCGGGCGTGGTGGCAGGCGCCTGTAGTCCCAGCTACTCAGGAGGCTGAGG

CAGGAGAATGGCGTGAACCCGGGAGGCGGAGCTTGCAGTGAGCCGAGATTGCGC

CACTGCACTCCAGCCTGGGCAATAGAGCGAGACTCCGTCTGGAAAGAAAAAAAA

AAAAAAGAGCTGTTACTGTTGACAGTAGCATGAGGTAGACCATGGCCTGCACCA

AAATGGGGGAGTGGAGTGCCACTGAGGCCAGAAGGAACCACACCCTCAAGGGT

GGGGAGTTATGGTATGGGGGTCCTAGGCATGGAGTCTTTTAATTCTTTAGACAA

TCCTGGGAGCAACTGTCCCTGTTTCACAGAGGGGGGGCCACACAGCTGGTGAG

TGGGCAGCCAAGACTCTGTTCAAGTTTGTGTGGGTCCAACACTTGCGGCCACGGT

GGAGGGGCATCTGAGCCAGGCCTCAGAGAGTGGCGGGGGAAGTTGGGTGGGGA

AGTGTGCCCTTCTCATTCCTCTGAGGCTCATCCTCTTGGTGCCTCTCTTTCATGGA

AAGGGATAATAAGGTTATTGTGAGGATCCCCTGAGTTCGTATATTCAGACGCTTA

GACAGAGCCAGGCACAGAGAAGGGCCCGGGGTTGGCTAGTTTGATTGCTGGTGT

AATTGCTAATATCTTCCAGTTTGTATTGGTCAAGGTTCTGCAGAGAAGCAGAACC

AGTAGGATGTATATATTAAGAGTTTCAAGCTCATGTGACCGTGCGGGCTGGCAAG

TCTGAAATCCGCAGGGCAGGCCAGGCAGGCTGGCAATTCCTGCAGAATTTGATG

TTGCAATACTGAGTCCTAAGGCAGTCCTGGGGCAGAATTCCTTCTTCCCTGGGAG

GCCTCAGTCTGTTCTCTTAAGGCCTTCAACTGATTAAATGAGGCCTGCCCAAGTT
```

-continued

```
ATAGAGAGTAACCTGCCTTACTCCGTCTTCTGATTTAAATGTTAGTCACATCTAA

AAAATATTTTCGCAGCAGCATTTCCACTGGCTTTTGACCAAACATCAGGCCACAA

AGTTGATCCCCAAAATTAACCATCACTCTGTGCCTGTAAGGGAGGGGCTGGGAA

AGGGGAGCAGGTCTCCCCAAGGGGTGACCTTGGCTTTGTTCCTCCCAGGCCTGGA

GTTTATTCGGAAAAGCCAGCTGGTCCAGCCTGTGGGGCCACTGGTGGTGCTGCTG

CCCCTGGCGGGTGGGTACAGCCGCGTCCTCAACGCCGCCTGCCAGCGCCTGGCG

AGGGCTGGGGTCGTGCTGGTCACCGCTGCCGGCAACTTCCGGGACGATGCCTGC

CTCTACTCCCCAGCCTCAGCTCCCGAGGTAGGTGCTGGGGCTGCTGCCCCAAGGC

GCGGGTAGGGGCGGAGGGCGGAGGGCGGAGGGAGGGCGGGCGGGCAGGCGG

GCTTCTTGTGGCACGTGGGCTTCTTGTGGCACGTTCCTGGAGGCCGAACCCTTCT

GGCTTTGGAAGGAGTCGTCAGAGACCCCCGCCATGCGGGAGGCTGGGGAGGAAG

GGGCTCGAAACCTCCATCATCGCAGAGTCTGAATAGCAGTGGCCCCGCCATGCG

CCCACGTAGCGGCGCCTACGTAGCCACGCCCCACACCCCGTCCTGGCCACTCTC

CCTCCTGAAGGTCTTCTGGTACCCGCCCCCTCCCCATCTCCATCCCCAGGCCCTGC

GTCCTCTGCCCAATACTCTTTGGGCCTCCCTGTTGTCCAGCTCTCTCCGCGGCTCC

ATGACTGACAACTTGAGCAAGGCTAATGTGAATGGGAGCGGTTGAGGGCTCAGA

CCTCTCACCCGAGGAACATCCACAGAGTGTGCCGCATGCCCGGTGCAGTGTGGCT

GCGGGGACACAGACACGGAGCCTCGGCCCTGAGGAGCTGGGGGGCAGTGACCG

TCCCTCCTCTGACCCACCACTCCTCCAGTGTCAGGACACTGCGGGTATCTAGGGG

AAGGAATCTTGTTCCACTTCAAGTCTGGAACTTCAAGTCTGTGTGTGTGCGTGCG

CGCGCGCGCGTTGGGGGTGGGGGTTGCAGAGCAGATGCGTACCTGACAGCGGTA

ACCTAGGTCCCCCCTGGCCTATCAAGGCTTCCCTGGCGGCCGAATTTAAAGGCAT

CAAGCAAACAAAGCCCAACACATCTCTGCCTTGTCCTCTCAGTTTCCCCCCGTGG

CACTTAGAACCACTTGATACACCGAATAGTTTCCTATCTCCCCCACTAGGATGTA

AACTCCACAGGGGCATTGGGAATGCTGCCTGGCTATGGTAGGGACAGAGGGGAG

CACCAGGGCGGGGCAGGGGTGCCAGAGTTCTGCCTGGGCAGTCAGATTTTCCTT

AGGAGGGGACATTTGAGTGGGACCCAAACAGGTGTATAGCAGTTGTCCAGCCCA

GCTGGCAAGGCCTGAGTCTGCCTCTGCAACCCCTCTCTTGGGCTCCTTTCTCTGCC

ACCCACCTCCTCACCTTTCCAGGTCATCACAGTTGGGGCCACCAATGCCCAAGAC

CAGCCGGTGACCCTGGGGACTTTGGGGACCAACTTTGGCCGCTGTGTGGACCTCT

TTGCCCCAGGGGAGGACATCATTGGTGCCTCCAGCGACTGCAGCACCTGCTTTGT

GTCACAGAGTGGGACATCACAGGCTGCTGCCCACGTGGCTGGTAAGTCACCACC

CCACTGCCTCGGCCACCGTGATGCTAACAGCCCCTTTGGCAGTCAGGGTCTGTGC

CGGGACCTCCAGTGCCAGGCTCTGTGCAGGGGACCAGAGATGAAGTAGGCCTG

ATGGTGCCTTCAAGGACACTCAGTCTGATGAGGGAGGCGAGTGCACAGAGGAAA

CACGAGGTCAGGGCTGTATTAGAGGGAGCCCAGAGGAGGCACCTGCCCAGCCCG

AGGGTCAGAGAAGGCATCTTGGAGGAGGGACATTTGATCGGGAGCTTGATGGAT

GAATAGGAGTTCACCTGGCCGATAAGACAGCAACTACCAAGGCTTAGAGGTGTG

AGAGGAGGCTGTCTTACCTCACTGAGTAAGGACTGCAGGCGGCTTACCTTCGAG

AAGAGAGCTTAGTGTCTGTGTGCACGTGTGTTTGTGTGTATGTGTGTGCGTGTGT
```

```
GCACTGGCAGGAGTCCCCTGCTGGGGCAGGAGGGCCGGGCCATCACCATCTTTC

ACCATTCACCCCTGCACCAGGCATTGCAGCCATGATGCTGTCTGCCGAGCCGGAG

CTCACCCTGGCCGAGTTGAGGCAGAGACTGATCCACTTCTCTGCCAAAGATGTCA

TCAATGAGGCCTGGTTCCCTGAGGACCAGCGGGTACTGACCCCCAACCTGGTGG

CCGCCCTGCCCCCCAGCACCCATGGGGCAGGTAAGCAGGATGGCAGGGTGGGCA

AGTCCAGGCTGGGGCTTGGGAGGTCTGTGTGACCTTGACAGTCTCTCCCTTCTCC

CTTGTCTGTGTAAGGAGGATGACGCCACCTTAAATAGGATTAAATGAGAATGGG

GCTCTGAAAGGGCTGTGCAATATTTTCATAACGTGTTTTTATAGAGACAGTTGAG

TATGTTCTTTAAGCCCTCCTCTCTCCTACCATGAACTAAAGATTTCTGTGGAGGTC

CCCTCACTCCCAGCACCCCCTCCTCATCCCAGGCCCTTTTTGCAGGTTGGCAGCTG

TTTTGCAGGACTGTATGGTCAGCACACTCGGGGCCTACACGGATGGCCACAGCC

GTCGCCCGCTGCGCCCCAGATGAGGAGCTGCTGAGCTGCTCCAGTTTCTCCAGGA

GTGGGAAGCGGCGGGGCGAGCGCATGGAGGTGACTGTACCCCTCCTTCGTGTGT

GTGTGTGTGTGTGTGTGTGTGTGTGTGTGTGTGTGTGTGTGTCAGTGCTGGG

CCCTCAGGGACCCCCAGCAAGCCCCTCCATCCTCCAGACTCCAGCTCTTCTGTAA

GCTTACAGGGCTGGCCAGACCAGGAGTGGGGCACTCCTCACTTCACGCGGCTGG

GGGCTGCTGGAGAGAGCCACAGCGGGAAGGGTTTCCTAGAGGCTGCAGGACAGT

GCTGGATGGATTTTCAATGCTCACCTGGGTGTGAGCGTGCGGCAGGGCCGCGTG

AGGGTCAGCGATCTGCTACTCTGGACTCAGCCATCTCTAGGCCCCTCTCACTCAG

GTGCTCCATGGTTCTGGGAGCTGAGAAATCTCAAACCAGCAAAAAAGTGGAATT

GATGTTGATGCTACAGGATAGTGCACAGATGCCATCTGGTTGCAGCATTTTGGTG

GAAGGGCAGTGCCCAGCTAGGAGAGTGAGGAGGGGCAGGCATTTCTGGCTTGAG

GAGATGGGGTCTTAATGCTCGTGTGAGAGGCAGAGTGGGTGGAGTGGAGCTGGC

TGGATCCTTGCTTTGGCCTCCTGGATTTCTCTCTATCTCCATTTTGAAACCACTCT

GTGTTTGGAAGAACTTTTGAGTATTCAGAGCTGCCCACTGGCAGAACAGTCTTCC

TTGGGCAGGAGTGAGCTCCTTGTCCCCAGAAGGCTGGGTCTGGCTGGCCCCTGGC

AGGGACACTGATGAGGGTGCTTGAGTTGATCCTGTCTAGTCCCTTTCTGTGTTTTC

AAAGCCCATTCTAAAGCAGATTCCCATTTCCGTCTTTGACTCTAAGGCCCAAGGG

GGCAAGCTGGTCTGCCGGGCCCACAACGCTTTTGGGGGTGAGGGTGTCTACGCC

ATTGCCAGGTGCTGCCTGCTACCCCAGGCCAACTGCAGCGTCCACACAGCTCCAC

CAGCTGAGGCCAGCATGGGGACCCGTGTCCACTGCCACCAACAGGGCCACGTCC

TCACAGGTAGGAGGCTGGGCTTGCCCTGGGGTGAGGAGGGGTCTCTTTCTCCTTA

TGCACCCACTGCCCGCGAGGCTTGGTCCTCACAAGTGTGATCCATGAGACTCAAG

CCTGACTTGCAGTTCCATACTCTGGTTCTGCCACTTCCATGCCCTTTGAGCCTGGG

CAGGTGACCTTACTTCTCCTCATCTCAGCTTCCTCCTCCATAAGAGGGAAAAAGG

TATTACCTGCCTCATTGTGTTGCAAGGAGATGGGCAGCATCTAGGGCACTGGCCT

GGAGTATCGCAGGTGCTTTGCCTAAGGTGGTGCAGTCCAGGAGAGGCAGCTCCA

GAGAGAGGCCCCCGGCTGGGGCTGAAAGGAGGGCAGACCTCGGTTTGAATTTCA

CCCTGCCGCTCTATAGCTGTGTGACTTGGGCAAATTACTTAACATCTCTGTATGA

GGAAATGATGAGTGCTAAGCACTTAGCTTAGTGCCGGGACAATATAAATTCTAG

CTATCGTTACTATTGTTTTCATCACCCGTTGCTTTAAAATCCAGCCTCTGGTATAG
```

-continued

```
GCAACTATTGACGGGCTACCCTGTGTCGAAAACATGCCCAGGCAGGTAGCAGGA

AGTCACAGATGGGGACCTCTTGGGGCATCAAGGGATGGTGCCCTGAGGCTGAGC

TGTTCTGGTTGGGTGGAGCATGAGAGGTCTGGGAAGACAGTGGGACTCCAGCCT

GGAATAAGAGGCTCAGAGTTGATTCTCGTCTGAGCACGTCCAGGGGAACCACTG

AGGGTTTGGGAACAGGAGAGTGAGGGTGAGAACCTGGTTCTGGGCACAGCAGGC

TGGCATGTAGGATGGATGTTCAGGAAAGATGAGCATAGTCAGGTGGCTGGTGCC

CTTGTCCAGGGGAGAGGCTCCGTCAGGTTCAGGGGTCCTGGCTTGGAGGGAAGT

CCGCCATGCTCTAATCACGCTCCCCTTTGGAAGTGCTCAGCCGATGAGCTCACAG

GCACATGTCAGTTTGAAGTCATGGAATCTGACTCCATGAAGCGCACCTCAAAGA

GCACCATTTTGCAGCTAAGGGAACTGCAGGCTGGACATGCTGAGTGGCTGCCCC

GAGCCCTTGCAGCTAGGACATAGAGAATGCTAGTAACCACAACCCTACCATGTT

CAGAGCACATGCCAGGCTCCATGCTGGGGCTTCGCACGTGTCATCTTCACAGTGT

CCCTGTGAGTAGGTGTGGTTTCTCTTTCCATCTTACAAATGAGTAAACAGAGCCT

CAGTGTAGCTAAGTAACCACTATTTTAGGTTTCTTAGCCAATGGGTGTGTCTGAC

TCCTAAGCCCATGGAGGGCATTCTGAGGTGGTTCAGACAGACCCCGGCTTACCCT

TGAACTTCTGCCTGCTGGCTGCATAGGGAGGGGCTGGGGGGAGTTTGAGCATCTC

AGGCCATAGAGCCCCTGCCTCACTGTCTCCATCTCTGGGTGGAAAGATGGTGTTT

TCCCTGAGAAACTAAGGCTCAGAGAGGTTGAATGGCTCTCCCAAGGTCACACAG

CTGGTCAGCTGCAGAGTTGAGAACACAGGAGTCCTGGTGCTCAGGCCAGCATCT

CTTTTTTTCTTTGAGTIGTTTCTAGGTTTCCTAGCTCTTGCCTCAGACCTTAAAGAG

AGAGGGTCTGATGGGGATGGGCACTGGAGACGGAGCATCCCAGCATTTCACATC

TGAGCTGGCTTTCCTCTGCCCCAGGCTGCAGCTCCCACTGGGAGGTGGAGGACCT

TGGCACCCACAAGCCGCCTGTGCTGAGGCCACGAGGTCAGCCCAACCAGTGCGT

GGGCACAGGGAGGCCAGCATCCACGCTTCCTGCTGCCATGCCCCAGGTCTGGA

ATGCAAAGTCAAGGAGCATGGAATCCCGGCCCCTCAGGAGCAGGTGAAGAGGCC

CGTGAGGCCGGGTGGGTGGGGTGCTGCGTGTCTCTCCTGCACAGCTTTTCTGTGT

CAGTTTGTGCCACCACCATACCGCCATGCATCAGGGTGGCGGTTTGCCAGGTAGA

TGCTGTGGGCAGCTTCCGCCATTGTGTGGACAGCATGTATATGTGTCTCTGTGTG

GCTGGGTCTGTTTTTGCTTTTGTCCAGATCAGTAAGGTTTGCTACCTGGGTACCCC

ACTCCACTTGGAGTAGAATGTGCATAAATATGGCATAAAGAAATGCAATATGCA

TGCATTTATTGATTGATCTATTTTTTTCTGAGATGGGGTCTTGCTGTGTTGCCCAG

GCTGGTCTCAAATTCCTGGGCTCAAGCAATCCTCTGGTCTCAGCCTCCCCAAGTG

TTGGGATTATAGGCATGAGCCGCTGCACCTGGCCTCTCTGATCTATTTAACAAAC

CTGCTGGGAGGGTCTCAGGGTCAGGAGCAGCACTGGGCTCTGAGGACACAGAGC

TCACTCAGCCGTGACCCAGAGGGGGTGCCTGAGCTGCATGCTGAAGGTTGTTAG

CATGACCAGCAAGGCAAGAAAAGGCCCTGCCGAGATTAGCAAGGCATGTGCCAA

GCCCTGGAATGTGACAGCCGGGCCTTCTAGAAACCTGAGTGTATAACTCTCCTTA

AAAGCCAGTAGGAGCTCCTCAAAAGGCAGCCCTAAGGAGTCCACTCTTAAATGA

ACTCAGAGTCAGTTTTAAAATGCAAGTCTGTGTTGATTCTGGTCTGGATGGTGCA

TTCCTCGAGAGCAAAAGACAGTCTTGGTCTTGGATCCACTTGCCCTGGGTACACT
```

-continued

```
GAGGGCTGCTAGGTTCCAGGTGCTCTTCCTGGCACTGGGGAGGGATACAGGCCC
AAGAGACATGCTGTTCTCCCTCCTGGAGCATCTATTTTAGTGGAGGAAGACAGAA
AACAAACCATTAATATAGAGTACTGAAAAGATGCGATGGAGAAAACTATAGCAA
GGAAGGGAATGGGGTGGGAGAGAGGTCAGGAGAGGTCTCGCTGACAAGGTGGA
CGAAACAGGCCATGAGGCAGAGAACATGTTCCAGGCAAAGCAAAGGCCCCCAG
GTGGGGATGTGCAGGGAGTACCAGGAAACCAGAGAGGTGGGAATAGTTATGAG
ATGGGGGGTGCCTCAGAGGGGACAGGGCCAAGTCAGGTGAGACCTGAGGGTCA
CAGTCAGCAGTGAGCTGGGGCCATGCAGGGGTCTGGCCTCAGAGGAGTGTGGTC
TGGCCTGGATCTGAACCTCTCACTGTGGCCTAGCTGCTGAGCTGAGAAGAGATGA
CAAGGACCTTGGGCAGAAGCAGGGAGACTGGAGGGAGGCGGTGGAGGGTCCAG
GCGTTGGGGCGGGGCTCAGGCTGGAGTCTGAAGGGAGCCTGCAGGCCTGGTGGG
TGGATGTGGGTGGGAGAGGGGGAGGATGGCACCAAGGCTCGGGCCCCTGGACA
GATGGAGTTGCCATTAAGTGGGATGGGGCAGGCTATGGGGCCATCAGTTTCAGA
GGGATGAGTTTGGCACTGGCATGGTAGGCATCTGTCTATCTCCACGGCCCTCAAA
CCAGGCATGAAGCAGGAGCTCACGTGTTTGGTCAGCCATGGTGCAGAACCGCCT
GGGTGGGAGGTGCGGGGTGGGAGATACACGGTTGTGTCCCAAATGGGCTCTGAG
CCAGCGAGGGCCGTCTGCACTTTGGCCTCACAGAAGGATGTCGGAGGGAGAAAT
GAAGTGTGGGTGGGGGTCCCGGGCCACGCTAGACATGTGCTTTCTTTTCCTCGGG
CTCTGGCAGGTGACCGTGGCCTGCGAGGAGGGCTGGACCCTGACTGGCTGCAGT
GCCCTCCCTGGGACCTCCCACGTCCTGGGGGCCTACGCCGTAGACAACACGTGTG
TAGTCAGGAGCCGGGACGTCAGCACTACAGGCAGCACCAGCGAAGGGGCCGTG
ACAGCCGTTGCCATCTGCTGCCGGAGCCGGCACCTGGCGCAGGCCTCCCAGGAG
CTCCAGTGACAGCCCCATCCCAGGATGGGTGTCTGGGGAGGGTCAAGGGCTGGG
GCTGAGCTTTAAAATGGTTCCGACTTGTCCCTCTCTCAGCCCTCCATGGCCTGGC
ACGAGGGGATGGGGATGCTTCCGCCTTTCCGGGGCTGCTGGCCTGGCCCTTGAGT
GGGGCAGCCTCCTTGCCTGGAACTCACTCACTCTGGGTGCCTCCTCCCCAGGTGG
AGGTGCCAGGAAGCTCCCTCCCTCACTGTGGGGCATTTCACCATTCAAACAGGTC
GAGCTGTGCTCGGGTGCTGCCAGCTGCTCCCAATGTGCCGATGTCCGTGGGCAGA
ATGACTTTTATTGAGCTCTTGTTCCGTGCCAGGCATTCAATCCTCAGGTCTCCACC
AAGGAGGCAGGATTCTTCCCATGGATAGGGGAGGGGCGGTAGGGGCTGCAGG
GACAAACATCGTTGGGGGGTGAGTGTGAAAGGTGCTGATGGCCCTCATCTCCAG
CTAACTGTGGAGAAGCCCCTGGGGGCTCCCTGATTAATGGAGGCTTAGCTTTCTG
GATGGCATCTAGCCAGAGGCTGGAGACAGGTGCGCCCCTGGTGGTCACAGGCTG
TGCCTTGGTTTCCTGAGCCACCTTTACTCTGCTCTATGCCAGGCTGTGCTAGCAAC
ACCCAAAGGTGGCCTGCGGGGAGCCATCACCTAGGACTGACTCGGCAGTGTGCA
GTGGTGCATGCACTGTCTCAGCCAACCCGCTCCACTACCCGGCAGGGTACACATT
CGCACCCCTACTTCACAGAGGAAGAAACCTGGAACCAGAGGGGGCGTGCCTGCC
AAGCTCACACAGCAGGAACTGAGCCAGAAACGCAGATTGGGCTGGCTCTGAAGC
CAAGCCTCTTCTTACTTCACCCGGCTGGGCTCCTCATTTTTACGGGTAACAGTGA
GGCTGGGAAGGGGAACACAGACCAGGAAGCTCGGTGAGTGATGGCAGAACGAT
GCCTGCAGGCATGGAACTTTTTCCGTTATCACCCAGGCCTGATTCACTGGCCTGG
```

```
CGGAGATGCTTCTAAGGCATGGTCGGGGGAGAGGGCCAACAACTGTCCCTCCTT

GAGCACCAGCCCCACCCAAGCAAGCAGACATTTATCTTTTGGGTCTGTCCTCTCT

GTTGCCTTTTTACAGCCAACTTTTCTAGACCTGTTTTGCTTTTGTAACTTGAAGAT

ATTTATTCTGGGTTTTGTAGCATTTTTATTAATATGGTGACTTTTTAAAATAAAAA

CAAACAAACGTTGTCCTAAC
```

Human PCSK9 Amino Acid Sequence (NP_777596.2)

(SEQ ID NO: 6)
```
MGTVSSRRSWWPLPLLLLLLLLLGPAGARAQEDEDGDYEELVLALRSEE

DGLAEAPEHGTTATFHRCAKDPWRLPGTYVVVLKEETHLSQSERTARRL

QAQAARRGYLTKILHVFHGLLPGFLVKMSGDLLELALKLPHVDYIEEDS

SVFAQSIPWNLERITPPRYRADEYQPPDGGSLVEVYLLDTSIQSDHREI

EGRVMVTDFENVPEEDGTRFHRQASKCDSHGTHLAGVVSGRDAGVAKGA

SMRSLRVLNCQGKGTVSGTLIGLEFIRKSQLVQPVGPLVVLLPLAGGYS

RVLNAACQRLARAGVVLVTAAGNFRDDACLYSPASAPEVITVGATNAQD

QPVTLGTLGTNFGRCVDLFAPGEDIIGASSDCSTCFVSQSGTSQAAAHV

AGIAAMMLSAEPELTLAELRQRLIHFSAKDVINEAWFPEDQRVLTPNLV

AALPPSTHGAGWQLFCRTVWSAHSGPTRMATAVARCAPDEELLSCSSFS

RSGKRRGERMEAQGGKLVCRAHNAFGGEGVYAIARCCLLPQANCSVHTA

PPAEASMGTRVHCHQQGHVLTGCSSHWEVEDLGTHKPPVLRPRGQPNQC

VGHREASIHASCCHAPGLECKVKEHGIPAPQEQVTVACEEGWTLTGCSA

LPGTSHVLGAYAVDNTCVVRSRDVSTTGSTSEGAVTAVAICCRSRHLAQ

ASQELQ
```

Apolipoprotein C3 (APOC3)

In some embodiments, the target gene for modification using the compositions and methods disclosed herein is gene encoding APOC3. The LDL-R mediated cholesterol clearance pathway involves multiple players. Non-limiting examples of protein factors involved in this pathway include: Apolipoprotein C3 (APOC3), LDL receptor (LDL-R), and Increased Degradation of LDL Receptor Protein (IDOL). These protein factors and their respective function are described in the art. Further, loss-of-function variants of these factors have been identified and characterized, and are determined to have cardio protective functions. See, e.g., Jorgensen et al., N Engl J Med 2014; 371:32-41 Jul. 3, 2014; Scholtzl et al, Hum. Mol. Genet. (1999) 8 (11): 2025-2030; De Castro-Oros et al., BMC Medical Genomics, 20147: 17; and Gu et al., J Lipid Res. 2013, 54(12):3345-57, each of which are incorporated herein by reference. Thus, some aspects of the present disclosure provide the generation of loss-of-function variants of APOC3 (e.g., A43T and R19X), LDL-R, and IDOL (e.g., R266X) using the methods and compositions disclosed herein.

Apolipoprotein C-III (APOC3) is a protein that in humans is encoded by the APOC3 gene. APOC3 is a component of very low density lipoproteins (VLDL). APOC3 inhibits lipoprotein lipase and hepatic lipase. It is also thought to inhibit hepatic uptake of triglyceride-rich particles. An increase in APOC3 levels induces the development of hypertriglyceridemia. Recent evidence suggests an intracellular role for APOC3 in promoting the assembly and secretion of triglyceride-rich VLDL particles from hepatic cells under lipid-rich conditions. However, two naturally occurring point mutations in human apoC3 coding sequence, A23T and K58E have been shown to abolish the intracellular assembly and secretion of triglyceride-rich VLDL particles from hepatic cells.

Loss-of-function mutations that may be made in APOC3 gene using the methods and compositions described herein are also provided. The strategies to generate loss-of-function mutation are similar to that used for PCSK9 or ANGPTL3 (e.g., premature stop codons, destabilizing mutations, altering splicing, etc.).

In some embodiments, the gene modification methods and compositions described herein reduces expression of functional APOC3 protein encoded by the APOC3 gene in the cell. In some embodiments, the modification reduces expression of functional APOC3 protein encoded by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 97%, at least 98%, at least 99%, at least 99.5%, at least 99.9%, or 100%. In some embodiments, the modification reduces expression of functional ANGPTL3 protein encoded by the APOC3 or ANGPTL3 gene in the cell by at least 2 fold, at least 3 fold, at least 4 fold, at least 5 fold, at least 10 fold, at least 20 fold, at least 25 fold, at least 30 fold, at least 40 fold, at least 50 fold, at least 60 fold, at least 70 fold, at least 80 fold, at least 90 fold, at least 100 fold, at least 200 fold, at least 300 fold, at least 400 fold, at least 500 fold, at least 600 fold, at least 700 fold, at least 800 fold, at least 900 fold, at least 1000 fold, at least 2000 fold, at least 3000 fold, at least 4000 fold, at least 5000 fold, at least 6000 fold, at least 7000 fold, at least 8000 fold, at least 9000 fold, or at least 10000 fold. In some embodiments, the modification abolishes expression of functional APOC3 protein encoded by the APOC3 gene in the cell.

The protein sequence of human APOC3 can be found, for example, at Deposit No. NP_000031.1, which reference is incorporated herein in its entirety. Human nucleic acid sequences can be found at e.g., GenBank Accession Nos.: NG_008949.1, which sequence is incorporated herein in its entirety. Mouse, rat and monkey APOC3 nucleic acid sequences have been deposited; see, e.g., Ensembl accession number ENSMUSG00000032081, ENSRNOG00000047503, and ENSMFAG00000001837 respectively, each of which sequences is incorporated herein in its entirety.

The polypeptide and coding nucleic acid sequences of APOC3 and of other members of the family of human origin and those of a number of animals are publicly available, e.g., from the NCBI website or ENSEMBL website. Examples include, but are not limited to the following sequences, each of which sequences are incorporated herein in their entireties;

NG_008949.1:5000-8165 *Homo sapiens* apolipoprotein C3 (APOC3), RefSeqGene on chromosome 11

(SEQ ID NO: 62)
CTGCTCAGTTCATCCCTAGAGGCAGCTGCTCCAGGTAATGCCCTCTGGG

GAGGGGAAAGAGGAGGGGAGGAGGATGAAGAGGGGCAAGAGGAGCTCCC

TGCCCAGCCCAGCCAGCAAGCTGGAGAAGCACTTGCTAGAGCTAAGGA

AGCCTCGGAGCTGGACGGGTGCCCCCCACCCCTCATCATAACCTGAAGA

ACATGGAGGCCCGGGAGGGGTGTCACTTGCCCAAAGCTACACAGGGGGT

GGGGCTGGAAGTGGCTCCAAGTGCAGGTTCCCCCCTCATTCTTCAGGCT

TAGGGCTGGAGGAAGCCTTAGACAGCCCAGTCCTACCCCAGACAGGGAA

ACTGAGGCCTGGAGAGGGCCAGAAATCACCCAAAGACACACAGCATGTT

GGCTGGACTGGACGGAGATCAGTCCAGACCGCAGGTGCCTTGATGTTCA

GTCTGGTGGGTTTTCTGCTCCATCCCACCCACCTCCCTTTGGGCCTCGA

TCCCTCGCCCCTCACCAGTCCCCCTTCTGAGAGCCCGTATTAGCAGGGA

GCCGGCCCCTACTCCTTCTGGCAGACCCAGCTAAGGTTCTACCTTAGGG

GCCACGCCACCTCCCCAGGGAGGGGTCCAGAGGCATGGGGACCTGGGGT

GCCCCTCACAGGACACTTCCTTGCAGGAACAGAGGTGCCATGCAGCCCC

GGGTACTCCTTGTTGTTGCCCTCCTGGCGCTCCTGGCCTCTGCCCGTAA

GCACTTGGTGGGACTGGGCTGGGGGCAGGGTGGAGGCAACTTGGGGATC

CCAGTCCCAATGGGTGGTCAAGCAGGAGCCCAGGGCTCGTCCAGAGGCC

GATCCACCCCACTCAGCCCTGCTCTTTCCTCAGGAGCTTCAGAGGCCGA

GGATGCCTCCCTTCTCAGCTTCATGCAGGGTTACATGAAGCACGCCACC

AAGACCGCCAAGGATGCACTGAGCAGCGTGCAGGAGTCCCAGGTGGCCC

AGCAGGCCAGGTACACCCGCTGGCCTCCCTCCCCATCCCCCCTGCCAGC

TGCCTCCATTCCCACCCGCCCCTGCCCTGGTGAGATCCCAACAATGGAA

TGGAGGTGCTCCAGCCTCCCCTGGGCCTGTGCCTCTTCAGCCTCCTCTT

TCCTCACAGGGCCTTTGTCAGGCTGCTGCGGGAGAGATGACAGAGTTGA

GACTGCATTCCTCCCAGGTCCCTCCTTTCTCCCCGGAGCAGTCCTAGGG

CGTGCCGTTTTAGCCCTCATTTCCATTTTCCTTTCCTTTCCCTTTCTTT

CTCTTTCTATTTCTTTCTTTCTTTCTTTCTTTCTTTCTTTCTTTC

TTTCTTTCTTTCTTTCTTTCTTTCCTTTCTTTCTTTCCTTTCTTT

CTTTCCTTTCTTTCTTTCTTTCCTTTCTTTCTCTTTCTTTCTTTCTTTC

CTTTTTCTTTCTTTCCCTCTCTTCCTTTCTCTCTTTCTTTCTTCTTCTT

TTTTTTTTAATGGAGTCTCCCTCTGTCACCTAGGCTGGAGTGCAGTGGT

GCCATCTCGGCTCACTGCAACCTCCGTCTCCCGGGTTCAACCCATTCTC

CTGCCTCAGCCTCCCAAGTAGCTGGGATTACAGGCACGCGCCACCACAC

CCAGCTAATTTTTGTATTTTTAGCAGAGATGGGGTTTCACCATGTTGGC

CAGGTTGGTCTTGAATTCCTGACCTCAGGGGATCCTCCTGCCTCGGCCT

CCCAAAGTGCTGGGATTACAGGCATGAGCCACTGCGCCTGGCCCCATTT

TCCTTTTCTGAAGGTCTGGCTAGAGCAGTGGTCCTCAGCCTTTTTGGCA

CCAGGGACCAGTTTTGTGGTGGACAATTTTTCCATGGCCAGCGGGGAT

-continued

GGTTTTGGGATGAAGCTGTTCCACCTCAGATCATCAGGCATTAGATTCT

CATAAGGAGCCCTCCACCTAGATCCCTGGCATGTGCAGTTCACAATAGG

GTTCACACTCCTATGAGAATGTAAGGCCACTTGATCTGACAGGAGGCGG

AGCTCAGGCGGTATTGCTCACTCACCCACCACTCACTTCGTGCTGTGCA

GCCCGGCTCCTAACAGTCCATGGACCAGTACCTATCTATGACTTGGGGG

TTGGGGACCCCTGGGCTAGGGGTTTGCCTTGGGAGGCCCCACCTGACCC

AATTCAAGCCCGTGAGTGCTTCTGCTTTGTTCTAAGACCTGGGGCCAGT

GTGAGCAGAAGTGTGTCCTTCCTCTCCCATCCTGCCCCTGCCCATCAGT

ACTCTCCTCTCCCCTACTCCCTTCTCCACCTCACCCTGACTGGCATTAG

CTGGCATAGCAGAGGTGTTCATAAACATTCTTAGTCCCCAGAACCGGCT

TTGGGGTAGGTGTTATTTTCTCACTTTGCAGATGAGAAAATTGAGGCTC

AGAGCGATTAGGTGACCTGCCCCAGATCACACAACTAATCAATCCTCCA

ATGACTTTCCAAATGAGAGGCTGCCTCCCTCTGTCCTACCCTGCTCAGA

GCCACCAGGTTGTGCAACTCCAGGCGGTGCTGTTTGCACAGAAAACAAT

GACAGCCTTGACCTTTCACATCTCCCCACCCTGTCACTTTGTGCCTCAG

GCCCAGGGGCATAAACATCTGAGGTGACCTGGAGATGGCAGGGTTTGAC

TTGTGCTGGGGTTCCTGCAAGGATATCTCTTCTCCCAGGGTGGCAGCTG

TGGGGGATTCCTGCCTGAGGTCTCAGGGCTGTCGTCCAGTGAAGTTGAG

AGGGTGGTGTGGTCCTGACTGGTGTCGTCCAGTGGGGACATGGGTGTGG

GTCCCATGGTTGCCTACAGAGGAGTTCTCATGCCCTGCTCTGTTGCTTC

CCCTGACTGATTTAGGGGCTGGGTGACCGATGGCTTCAGTTCCCTGAAA

GACTACTGGAGCACCGTTAAGGACAAGTTCTCTGAGTTCTGGGATTTGG

ACCCTGAGGTCAGACCAACTTCAGCCGTGGCTGCCTGAGACCTCAATAC

CCCAAGTCCACCTGCCTATCCATCCTGCGAGCTCCTTGGGTCCTGCAAT

CTCCAGGGCTGCCCCTGTAGGTTGCTTAAAAGGGACAGTATTCTCAGTG

CTCTCCTACCCCACCTCATGCCTGGCCCCCCTCCAGGCATGCTGGCCTC

CCAATAAAGCTGGACAAGAAGCTGCTATGA

NP_000031.1 Human apolipoprotein C-III precursor (SEQ ID NO: 63)
MQPRVLLVVALLALLASARASEAEDASLLSFMQGYMKHATKTAKDALSS

VQESQVAQQARGWVTDGFSSLKDYWSTVKDKFSEFWDLDPEVRPTSAVA

A

Angiopoietin-Like 3 (ANGPTL3)

In some embodiments, the target gene for modification using the compositions and methods disclosed herein is gene encoding ANGPTL3. ANGPTL3 has been associated with diseases and disorders such as, but not limited to, Arteriosclerosis, Atherosclerosis, Cardiovascular Diseases, Coronary heart disease, Diabetes, Diabetes Mellitus, Non-Insulin-Dependent Diabetes Mellitus, Fatty Liver, Hyperinsulinism, Hyperlipidemia, Hypertriglyceridemia, Hypobetalipoproteinemias, Inflammation, Insulin Resistance, Metabolic Diseases, Obesity, Malignant neoplasm of mouth, Lipid Metabolism Disorders, Lip and Oral Cavity Carcinoma, Dyslipidemias, Metabolic Syndrome X, Hypotriglyceridemia, Opitz trigonocephaly syndrome, Ischemic stroke, Hypertriglyceridemia result, Hypobetalipoproteinemia Familial 2, Familial hypobetalipoproteinemia, and Ischemic Cerebrovascular Accident. Editing the ANGPTL3 gene using any of the methods described herein may be used to treat, prevent and/or mitigate the symptoms of the diseases and disorders described herein.

The ANGPTL3 gene encodes the Angiopoietin-Like 3 protein, which is a determinant factor of high density lipoprotein (HDL) level in human. It positively correlates with plasma triglyceride and HDL cholesterol. The activity of ANGPTL3 is expressed predominantly in the liver. ANGPTL3 is associated with Dyslipidemias. Dyslipidemias is a genetic disease characterized by elevated level of lipids in the blood that contributes to the development of clogged arteries (atherosclerosis). These lipids include plasma cholesterol, triglycerides, or high-density lipoprotein. Dyslipidemia increases the risk of heart attacks, stroke, or other circulatory concerns. Current management includes lifestyle changes such as exercise and dietary modifications as well as use of lipid-lowering drugs such as statins. Non-statin lipid-lowering drugs include bile acid sequestrants, cholesterol absorption inhibitors, drugs for homozygous familial hypercholesteremia, fibrates, nicotinic acid, omega-3 fatty acids and/or combination products. Treatment options usually depend on the specific lipid abnormality, although different lipid abnormalities often coexist. Treatment of children is more challenging as dietary changes may be difficult to implement and lipid-lowering therapies have not been proven effective.

ANGPTL3 is also known to cause hypobetalipoproteinemia.

Hypobetalipoproteinemia is an inherited disease (autosomal recessive) that affects between 1 in 1000 and 1 in 3000 people worldwide. Common symptoms of hypobetalipoproteinemia include plasma levels of LDL cholesterol or apolipoprotein B below the 5th percentile which impairs the body's ability to absorb and transport fats and can lead to retinal degeneration, neuropathy, coagulopathy, or abnormal buildup of fats in the liver called hepatic steatosis. In severely affected patients, hepatic steatosis may progress to chronic liver disease (cirrhosis). Current treatment of hypobetalipoproteinemia includes severe restriction of long-chain fatty acids to 15 grams per day to improve fat absorption. In infants with hypobetalipoproteinemia, brief supplementation with medium-chain triglycerides may be effective but amount must be closely monitored to avoid liver toxicity. Another option for treating hypobetalipoproteinemia is administration high doses of vitamin E to prevent neurologic complications. Alternatively, vitamin A (10,000-25,000 IU/d) supplementation may be effective if an elevated prothrombin time suggests vitamin K depletion.

In one example, the target tissue for the compositions and methods described herein is liver tissue. In one example, the gene is ANGPTL3 which may also be referred to as Angiopoietin 5, ANGPT5, ANG-5, Angiopoietin-Like Protein 3, Angiopoietin-5, FHBL2, and ANL3. ANGPTL3 has a cytogenetic location of 1p31.3 and the genomic coordinate are on Chromosome 1 on the forward strand at position 62,597,487-62,606,159.

Loss-of-function mutations that may be made in ANGPTL3 gene using the methods and compositions described herein are also provided. The strategies to generate loss-of-function mutation are similar to that used for PCSK9 (e.g., include, but are not limited to premature stop codons, destabilizing mutations, altering splicing, etc.).

In some embodiments, the modification reduces expression of functional ANGPTL3 protein encoded by the ANGPTL3 gene in the cell. In some embodiments, the modification reduces expression of functional ANGPTL3 protein encoded by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 97%, at least 98%, at least 99%, at least 99.5%, at least 99.9%, or 100%. In some embodiments, the modification reduces expression of functional ANGPTL3 protein encoded by the ANGPTL3 gene in the cell by at least 2 fold, at least 3 fold, at least 4 fold, at least 5 fold, at least 10 fold, at least 20 fold, at least 25 fold, at least 30 fold, at least 40 fold, at least 50 fold, at least 60 fold, at least 70 fold, at least 80 fold, at least 90 fold, at least 100 fold, at least 200 fold, at least 300 fold, at least 400 fold, at least 500 fold, at least 600 fold, at least 700 fold, at least 800 fold, at least 900 fold, at least 1000 fold, at least 2000 fold, at least 3000 fold, at least 4000 fold, at least 5000 fold, at least 6000 fold, at least 7000 fold, at least 8000 fold, at least 9000 fold, or at least 10000 fold. In some embodiments, the modification abolishes expression of functional ANGPTL3 protein encoded by the ANGPTL3 gene in the cell.

In some embodiments, a splice site disruption generated by a base editor system disclosed herein can result in the inclusion of intronic sequences in messenger RNA (mRNA) encoded by the ANGPTL3 gene. In some embodiments, the splice site disruption generates a nonsense, frameshift, or an in-frame indel mutation that result in premature stop codons or in insertion/deletion of amino acids that disrupt protein activity. In some embodiments, the splice site disruption generates exclusion of exonic sequences. In some embodiments, the splice site disruption generates exclusion of exonic sequences that results in nonsense, frameshift, or in-frame indel mutations in the ANGPTL3 transcript. Canonical splice donors comprise the DNA sequence GT on the sense strand, whereas canonical splice acceptors comprise the DNA sequence AG. Alteration of the sequence disrupts normal splicing. Splice donors can be disrupted by adenine base editing of the complementary base in the second position in the antisense strand (GT to GC), and splice acceptors can be disrupted by adenine base editing of the first position in the sense strand (AG to GG).

In some embodiments, a base editor system provided herein effects an A·T to G·C alteration in a ANGPTL3 gene when contacted with the ANGPTL3 gene. In some embodiments, the A·T to G·C alteration is at a splice donor site of the ANGPTL3 gene. In some embodiments, the A·T to G·C alteration is at a splice acceptor site of the ANTPTL3 gene. In some embodiments, the A·T to G·C alteration results in an aberrant ANGPTL3 transcript encoded by the ANGPTL3 gene. In some embodiments, the A·T to G·C alteration results in a non-functional ANGPTL3 polypeptide encoded by the ANGPTL3 gene. In some embodiments, the A·T to G·C alteration is at a 5' end of a splice donor site of an intron 6 of the ANGPLT3 gene.

The nucleotide sequence of human ANGPTL3 is provided, for example, in NG_028169.1, which is incorporated herein in its entirety. The protein sequence of human ANGPTL3 is provided, for example, AAD34156.1, which is incorporated herein in its entirety.

Mouse, rat, and monkey ANGPTL3 nucleic acid sequences have been deposited; see, e.g., Ensembl accession number ENSMUSG00000028553, ENSRNOG00000008638, and ENSMFAG00000007083 respectively., each of which sequences are incorporated herein its entirety.

The polypeptide and coding nucleic acid sequences of ANGPTL3 and of other members of the family of human origin and those of a number of animals are publicly available, e.g., from the NCBI website or ENSEMBL website. Examples include, but are not limited to the following sequences, each of which sequences are incorporated herein in their entireties;
NG_028169.1 Human angiopoietin like 3 (ANGPTL3), RefSeqGene on chromosome 1

(SEQ ID NO: 7)
AATGACAAACTGAAAAAATCTATTGTTTGTTATATATATAACAAAGAAT

TAGTATCCACAATATGTAAATAATTCCTAAAATTAGTCAGAAAGAGACA

AACTTAAAAAGAGGGTAACAAGGAGGGGAGCAAATTATGTACATAACCA

GATGATTCGCAAAGACGGCAACAGAGATGGCCAGCAAAACAAACTAGAT

ATATACTTGTCTATTAGATTTATCAACATTTTTTGCCTTTTTCATTAAA

AGCATTTGTAAAAGGATATAGGAAAAGAGGAACTCTCATATACTCCTGG

CAGGGATGTAAATTGGTACAACCCTTTTGAAGGACAATCTGACAAAAGC

AATCGTAAGTTACAAGTCAACATCTATGAATGTATATGAAAATATTTAT

ATACATACATCACCACCATAAAAGCATTTTCTATACATACTGTTTATAA

TTAGAAAATTGGAAACAAATGATTAAAAGGGGGCTGATTAAATTAAGGT

TCATCTATATAACAGGATTATGCAGCTATTAAAAAGGACGTGGTAACTC

TATAGACATTCATAGGAAAATAAATTTTAAAATACTAAGATCCTGAATG

ATATATATATCATGAGCTATTATACATAACAAGATCCCACTTGTGTTAT

AAAAAATTATGTTTAGTCATTCAAAGGGTCTGGTATGATAGACCCAAAA

TGTTAATAGAGTCGAGATTTTTATTTTTTATAGGTTTTTGAAATACCTG

AATTTTCACAATAAGTACTTTGCACATTAAAAATCTTAGCTGGGCATGG

TGGCTCACGCTTGTAATCCCAGCACTCTGGGAGGCCAAGGTAGGCAGAT

CACCTGAGGTCAGGAGTTCGAGACCAGTCTGGCCAACATGGTGAAACCC

CGTCTCTACTAAAAATACAAAAATTAGCCAGGCTTGGTTGGGGGTGCCT

GTAATTCCAGATACTCGGGAAGCTGAGACAGGAGAATCGCTTGAACCCA

GGAGGGGGAAGTTGCAGTGAGCTGAGATCACGACGCTGCACTCCAGCCT

GGGCAACAAAGAGCAAAACTCCGTCTCAAAAATAAATAAAGAAAAAATC

TTTACATGTCCAAAGATACGGCTGTTCAACTAAAAAATATATATGTATA

AAACTTAACATGTTAATAGTGAACACACAAAACAGTAAGATAGATAAAA

TTATTCCTTCAAAGCTCACTTAACCTCTGGATCTACACTGTCCAAAAAG

ACGGTCTAATGAGACAATTGAGCACTTGATAGGTGAGTGGTTCTAACTG

AGATATGTTCTCAGTATAAAACATACAATAGGATCTTCCTATACAACAT

TAATTAAAAACAAACTATTGTAGTTAAAAAGGAAAAAATTAGAGATAC

TATGTAAAAAAGAGCCAAAATACCTTGTATTTTATTTGAAAGACATATC

TCCATAAGATTACACAACCTCGTGTAGGATAAAGGACTTTGCTTTGCTT

GGAATTTAAACAATTTAGGCTCTTAAATGTCCTAAAATTCTCTGTAGCT

AAGAAATTTTTATATTGGTTCCTAGGAACTAGGAATCCTTAAATTAGGC

CCTACATTTGCTTACAAGTTTATTTTCCTTGGCATAAAATTTTTTAGTT

TTTACATTACTGGTTATATTTGATCAGGGTTCTATTTAAATAGGCACAA

GTTCAAGCAAAGATCAGATTCTGCTTTTAGCAGTGTGTACTCAGACAGG

AAGTATTAAAAGGCAGGCAGAAAATCCTTTATAAAATTACTACTTTCAA

TGCATTTTCCCACGTTGAAATGCTTCTGCAGTTTATAATTAGGCAAATT

ACTTTAATTATAATCAATAATGCTGTTCAAATTACTATAAGAATTATAC

AGATATTTATACCAAGAGACAATATACTAGAAACCAAGACTACGTGACC

ATTACCTCTACTCTGTCAGTGTTATTTGTGAGAAATTGCACAAATTTTG

CAAAAGTGTTAGTATCCTACTACAGTAGGATATAATATAGAAGGAAAT

AATTTCATAAAGCCTGTCTTTGGTACTAGTGCTCAGTTACTTTCATTAA

CTAAAAAGGGGCTACTCTTCAAATTCCCTTCTCTAAAAAGAATGTACT

ATATCAAAAGGGGGTAAACACTACTACGTATACATTCTGCACTTAGAAA

TCCCTATATGTTGATTTTATCATTCTCTTATTCAATAAATATTGTTTCT

ACAATGTGTAAGGCATTACTGTACTAAAGCATTATAAGGAATATAAGTT

AAAAACACATACAAATCTTGCCAATCAACAGCTTATAGTGTAATAGGGG

AGAGAAGCTGGCCCATCTATATTCTCCCTCAACTAGCAAGTGGATGAAA

TATCAGGGTCAATAGTTATAAGCCACAAAAGCTGACAGCTTAATTAAGA

GAAGTTTTGAAATATGTATTTCATGACCAATAATTACAACTGTAACTTT

TCTATTTAAAGAAGGAGAAAATTTGAATTTCTTCTCTAGCTCAACATAC

ACTTCTATAATTCCATTACATGAACCAGAGTAAAGGGTAAGATGGAAAT

GAAGAATATTTTCTTACCCTTTTGTGGTTCTATATTGGACACTTAAAAA

TCATACACAACCTAATCAAAAGATGTAATTCTTTAAAAAGGTACGAGAC

CAAAATTCAGAAAATCTAGACTATAACAAAATTTCTCAATTTACATTAT

CTTAATATGCAATTAATTTTCACCAGTAAAATACTATAGTATGGGTACA

AATGCATTGATTAGTTCTAATTACAAAAATGGCTAATATATAATACTGT

GTAGTGTTTATGATACATCAGATAATGTTCTAAGTGCTCTGAAAATATA

AACTTTTAATCTTTTATACGACCCTATAAAATAGGTGTTATTCTCACTG

GAGAGATGAGAAAACAGGGGTTCAGAGATGTGAAGTAATTTGACCAAAG

GTCACAAAGCTGAAGAATATGAAATCCGGGATTCTGATTCAGGCAGTCT

TATTCCAGAATCATGCTCTTAACCACTATGGAATACTGCCTCTACTGTA

ACTATTATACCCAAAACCCTTAATCCTAAGTCATCAAAAGGAAGAGCCT

CTATTTTACACAATGAAGAGGCATTTCTAAGAATAGAAATTTAGGGACG

AGCACAGTGGCTTACTCCTTTAATATCAGCACTTTGAGAGGCTGATATG

GGAGGTTCACTTGAAGTCAGGAGTTCAAGGTCAGCTTGGGCAACATAGT

GAAACACAGTCTCTACAAAATATTTAAAAATTAGCTGGGTGTGGTGGCA

TGCATCTATAGTCTCAGCTACTTGGGAGACAGAGGGAGGAGGCTTGCTC

GAGCCCAGGAGTTCGTGGCTATAGTGAGCTATGATCATGCCACTGCACT

CCAGCCTGGACAACAGAGCAAGACCCTGTCTCTAAAAAAGAAAAGAAAT

TTGGAAATGGTTTATTTTGTATTAACAATTTATAATTTACACTGAAATT

TATTATGATAAAACTTTTCCCTGTGTTAAAAAGCTATTAACTTTATGAA

AAATTTCTTTTAGGTAAGGTTGATTATATATACCCACACACATACACAG

GTTAAAAGTTAGTTTCATGTGACATAATAACTAGCATTTTGAGCACTAC

CTGTTTGCCCAGCACTGTTCTAAGTGCTCTACATGTATTATTGTTAAAT

```
TATCATAACACTATGAATTATGTACTATAATTACCCCAGCTTTACAGAT
GAGGAGACTAATCCATGGGAGGTTAAGTAACTTGTCCAAGGCCAGACA
GCTAGAGCCGGCTTTTGGACCCACACCACAGTCTGACTCCAGCACCCAT
ATTCTTAACAATTTCACCATATTAATATGTCAAGATTAAGCAGTTTTAA
AGGATGCTATTTTCTCACAAATTTCTTAATATGAACACTCAATAAGAAT
AATCACTAATATAAGCATTTAGTATTTTTTAACACTAAGTTGGAAGCA
TAGTGGAACATTTATTTTTAGAAATATTATTAATTGGCTGGGCTCACGC
TTGTAATCGGCTGGGCTCATGCCTGTAAATTTGGGAGGCCAAGGTAAA
AGAATTGCTTGAGCCCAGTATTTCCAGACCAGCATGGGCAATACATTAA
GACATCATCTTTAAAAAAAAATGTTATTAATCTCCTCTTTTGTTAAA
TGTATATTATCAAAATTGTTACTAAGCTAACAAACTTCAGAAAAACTTA
TGATGGGCAAGCTGCTTGTGACATTGAAGGTATTTAAGATTCAATTCTA
GTTTGGTCCTAGATGACCACATATCCATTGTTCCTTCAACGAGCACATG
GTAAAGAGCCTAGAACACAGAGACACAGAACACAGTGGAGAAAAGGGAG
TGAAATGTCTTTAATGACACTTACTATATATGGGATTTTGTGACAATAT
ACAAGGATGGTTAAGACATATAAGGTGATGCAAAAAAACATATTAACAA
TTATAGTGACAAAAAATGAGGAGCATATAATTATACATTGATTTATACA
GAGTACCAGAGGAACACAGCATTGAGAGCCGTAACACCACCTGAGGGAG
TGGAGAAAGGCTTCAGAGAGAAAGTGTTTTTTGGAATGGATCACTGTTT
CCAAAAGAACTAAAGTACAGTTTGAGAAATGCATACTTAATTCATTACT
TTTTTCCCCTCAACTTTAATAATAAATTTACCCAACAAAAAGTTTATT
TTTGACTTGTAAATCTCTTAAAATCATAAAAAAGTAAAATTAGCTTTTA
AAAACAGGTAGTCACCATAGCATTGAATGTGTAGTTTATAATACAGCAA
AGTTAAATACAATTTCAAATTACCTATTAAGTTAGTTGCTCATTTCTTT
GATTTCATTTAGCATTGATCTAACTCAATGTGGAAGAAGGTTACATTCG
TGCAAGTTAACACGGCTTAATGATTAACTATGTTCACCTACCAACCTTA
CCTTTTCTGGGCAAATATTGGTATATATAGAGTTAAGAAGTCTAGGTCT
GCTTCCAGAAGAAAACAGTTCCACGTTGCTTGAAATTGAAAATCAAGAT
AAAAATGTTCACAATTAAGCTCCTTCTTTTTATTGTTCCTCTAGTTATT
TCCTCCAGAATTGATCAAGACAATTCATCATTTGATTCTCTATCTCCAG
AGCCAAAATCAAGATTTGCTATGTTAGACGATGTAAAAATTTTAGCCAA
TGGCCTCCTTCAGTTGGGACATGGTCTTAAAGACTTTGTCCATAAGACG
AAGGGCCAAATTAATGACATATTTCAAAAACTCAACATATTTGATCAGT
CTTTTTATGATCTATCGCTGCAAACCAGTGAAATCAAAGAAGAAGAAAA
GGAACTGAGAAGAACTACATATAAACTACAAGTCAAAAATGAAGAGGTA
AAGAATATGTCACTTGAACTCAACTCAAAACTTGAAAGCCTCCTAGAAG
AAAAAATTCTACTTCAACAAAAAGTGAAATATTTAGAAGAGCAACTAAC
TAACTTAATTCAAAATCAACCTGAAACTCCAGAACACCCAGAAGTAACT
TCACTTAAAGTAAGTAGAAAATAAAGAGGGTTCATGTTTATGTTTTCAA
TGTGGATCTTTTAAAAAAAATATTTCTAAGGCATGCCATTTGAAATACT
TTGTTGCATTGTTGAAATACTTTTTTTTCCAAGAAAATAATCTCCAGA
AAATAAAATTTCCTATTATAATTTCAAGTTAGTTTTTTGTTTCCCTAAT
GTTATATATGAAAACACTGAAAATTTGCATTTTATATGAAAATTACAAA
TCGGTTAAATTATACAATCTAGAACACTATGTCATTACACTATTGTAAA
TTACTGAAGGTAAGTAAAAAGTTAAAAAAAATTTAAAACTATTCTCCAG
TGTTTAAAACAGATTAAATAATACAGTAAATGGAAAAGATTTATTCATA
TGAAAATATGCTGGGCTTTTTCTTTTAATTGAAGTTCAGAAAATCAAAT
TTTAGAGATAGTACAATTTAAATAAAATGTTAAGGACAAAAATATGTGC
TATTTGAAAGAAGCATACAAGGGGAAGGAATTGCCAATATTCATTTTTC
AAATCCATTATTAGTTTAAAAATTTAGATTATGATAGTGTTACAGGAAA
TTAATAGAAAAGAAAGAGGAAAGCAACTTATAACCAACCTACTCTCTAT
ATCCAGACTTTTGTAGAAAAACAAGATAATAGCATCAAAGACCTTCTCC
AGACCGTGGAAGACCAATATAAACAATTAAACCAACAGCATAGTCAAAT
AAAAGAAATAGAAAATCAGGTAAGTCAGTATTTTAATGGTATGTCCCAT
CTTTCACACAGGTCTGTAAAAACACTGAATCCTAAAATTATTTACAAGC
TTTAACTGGATCATGAGTAAAATTATCACATCAGCATAACTGTTAAAAT
TGCAGGCTCTGAAGCTAATAAACTACCTGCATTTAAACCATGGCTCTAA
AACTTTGTGTGACCTTGAATAAATTACTTCACCCCTTTATCTCTCAGTT
TCCTCACATATACTACAAAGATAATAACAGAACTTATAGGATTATTGTA
AGAAAAAAATTAATTCATAGCAGCCAATGTCATCTTACTAAAATTCAA
ATTAGATCATGTTTCTCTTTGCTCAAAACCACACAATAGCTTTCCATTT
CACTCATATTGGCTCTTTAGACCAAGATTACCCAACCCTTCGTCATCTC
ACTGACTTCACCTCCTCTACTCTAGTTATTCTGACCGCTTTACCAGTAT
TCAAACACATCAAACATACTGCCACCTCAAAGCCTTTGCCCTTGTTGTT
TCCTCTAACTGGAACGCTCTTCTGCCCTGGTATCTACGTGGCCCACTCT
CTGATTTCCCTTAGGGTCGTTATCAAACAAAAAATTCCCAATGAAGACT
TACAAGGTCACTTAACCAAAAATCACAACCGCCTGGTCCCATCCCTGAA
AACTTCTACTTCCTTAGCTACTTTTCTCCTGCACACTCACCTTTATTTA
ACATAACATAAATTTTAGTTATTTATCTCTTCTATTCCTGCACTAAAAT
GTAAGCTCTGTGAATACAGGGATTTTTTCCATTATCTTCATATTTTCCA
TTATTTGTATATACTCCAGAATATAGAATACTGTATGGCACACAGTAGG
CATTTCTGTTGAATTAATAAATGTAATGTCATATTCACACAGAAGCGTG
TGCTATGATTATTATTCTTGGATTACTAGAAATAGTGTGCCTCATAAT
TAAAGGTCAACATTCAACAATGTAATTAATCTACAATGTAAACATCTGG
TGAAGTGACAGAGGGAAGCACTTGTTTAGAAAAAAGCTATGTCAGAATC
CATGTATTCTAATATGCAGTACAATAGTTTAAAAATATTAATAATACTC
TCAAACAGCTATTCAAGAGGATTCAAAAAACATAATATAAACTCAGAGA
AACTGGTAAACAAAATCATTTTCAAGAGATATAAAACAAATATTATTAC
CAATTTCCACTAAACAAACATAATGTTAGTAGTGCTGCTAAAAGGTTTT
TTATCAACTACTTTTGGTTTCCATACTTTCCTTCTTATGATGTTATTAT
TCTAAATTCTTTTCAATTATATCTTTTACTATGATTAAATGAACCTGCT
```

```
CCCCAAAGCAAAATGTTACTATAGTAATATACATTGTGTCTAAAAATAA
AAATGTGTGAAGAAACCAAAACAATGAATTTCTGAGTTGGAAGAAGAGT
TAGATCATTTAACTTTCTCATATTTAAATTAAAAAAACAAAACTCTAAA
AATTTAAGTAACTTTAAGATCACATAGTTACTTAGTAGAAAAGAGTAAT
ACCCAGCAAGCAAACTTTACAATAGATCCTTTTAAATAAGGTCCTAGGA
AATATCATTCATGCCAGCATCAAAAAACTAACACTAATAATGCAAGATA
TTATATATTCTGCTTTTCTTACTGTCAATGAGAAAAACTATCATTCAAT
AAATTGCAAACCCAACACACTTAAATAAAAATAAAATGTTACTGCTAAA
CTAACGATAAACTACTGAATATATAGAAAGTAAGCAAACAAACTTGCCA
ACCTGCCAACATCTACAGATATGTTTACAGGTCAAAAATTATCAAATTA
TCAAGAAAGCCTGGTTCAAATTATGTATTATGTCTTTATCACAGGTCTG
AAGATCAGTAAGACCTAAAACTGAAAATTATTAAACTTAAAATCTGAAC
AGAATATCAAATATATTTTATTCATATAAATAAAAGAATACATTACAAT
ATTCTAAGCAAAGCAGTCTCTACTTTTGGCCTTGCTCTGTTTTCCGACC
AATGTCTGCTTTTTTGCCTTGCTTTATTTTTTTATCTTATTAAATAATG
TCCCTGATTAAATATTTTGAGAACAGGTAATCTGTACAATCTGAATAAC
ACTGTTTATCTAAATATCAAACACCGTTATAACATTATGAACTGAAAGA
CAAACTGTACTTCTGACATCCTTACTCAGATTTCCCCTAATTGTATATT
CAGTATCATTTTAAAAAACAGATTTATATTCTTTTATCAGCTCAGAAGG
ACTAGTATTCAAGAACCCACAGAAATTTCTCTATCTTCCAAGCCAAGAG
CACCAAGAACTACTCCCTTTCTTCAGTTGAATGAAATAAGAAATGTAAA
ACATGATGGTAAGACACTTTGGTGGGTTTCCTTCTTGAAGCTATTATTA
TCAAATTCCCTATTCTTAGGACTTGTTCTAGACTAAAAGATAGTTAAGA
GATATCCATCAAATACAATGTATCAACCTAAACTGGATGCTGGGGTTCT
TTTTACACCCTATAAAAGACATACCTAAGACAATCAGAGAAATACAAAT
ATGGACTTGATTATTAGATAATATAGAAGGTTTATTAATTTTCTTAGAT
GTGATCATGGTATTGCAGTTTTAAAGGAGAACAATCTCCTGTTTAAGAG
ATACATGCTGAAATATTTACGGAGTTAAAGGTCACTGGACTCCAGACTG
GTGATAGAACAAGACTCTGTCTCTAAAAAATAATTAATTTTTTAAAAGA
AAATAGTTTGGTAAGATGATTCTTACATTCTTAAATAACACGCCATCTA
AGAAAAATGCTTTAACATAAACATTACTGAAAAAATGCTACATTTGCCA
CAACTTCATAAAATGTCAAGTGAAATCTCAAGCTCCAAAGATATTATTC
CTATTACTAAATCTGATGTAATAACATTTTATTGATTCTAGGCATTCCT
GCTGAATGTACCACCATTTATAACAGAGGTGAACATACAAGTGGCATGT
ATGCCATCAGACCCAGCAACTCTCAAGTTTTTCATGTCTACTGTGATGT
TATATCAGGTAAAACCTGTCTAAGGAGAATAGACAGTAGTTAGTTCAAC
TTACTCATTACGTATTAGGAAGATTAACCTGGTTATCATTGTTTATAC
ATATATATATGAAATATATGAGTATTCGTATAAATATAATACTTTTA
CCTTGTTTATGTATTTACTCAATATTCTCCTTTTCCTCTAAAATAATCT
GAAGTGACTATTATCAATAAGTTTACTATGCCAAAATTCATTAATTGCC
```

```
TTTCACTTAACTTTTGGGACCATAATAAATAATAAAATGTATTGCCATA
ACATTAATAAACTACCTTACAAAACCACCAATTAAAATCAAACAAACAA
AAAAGTGTTATTTACATCTGTCAACATAAATCTACTAAAAATACATGAT
TTCATTCATTATATTCAGGTAGTCCATGGACATTAATTCAACATCGAAT
AGATGGATCACAAAACTTCAATGAAACGTGGGAGAACTACAAATATGGT
TTTGGGAGGCTTGATGGTAAGGGGACTACATTCAATCATTCATTCACTT
GCTAATCTACAAATATTTACTGAGAACCTCTTATGGACCAGGTATTAGG
AAAAGTAGTAACGAACGAGAAGCAGTCTCAGCCTTCATATAATTTATTA
TCAAACAATTACACATTTGTTAGTAAATTACACTTATTACAACTGTTAT
TATTTGAATTATATTTATCACAATTACATGTCTGTTCTTAAATATACTT
ATCACAATTTAATTCCACGGCTTACAATGATCATAACTATAATTATTAA
AGACAATTTTGATTAAATGTTATGTCATAAGTAGTAACTGTTACAAATA
AGCTGTGAAAAGAACCACTCCTAGCATTAGTCACTCTATTCTCTCATTA
ACGTTTTACATATCAATTAATTGGAAGTTAAAAGGACCAGGAAACTCAG
ACATACAGTATACATTTTAAAATTTCAATTATTTAAATATAATATATAG
AATGTATGGCTTATAATGAATTAGTTAACTCAATGCAAATTATTCTATT
TTGATTACAAATAGTAAAATAAGCAAGATAAAATAACAGATGTTTAAAA
TCCAAAAAGCACATACAAAAATCCATGAATGATGTCTAAGTACTCACTT
ATAAAGTAGAAGCATTCATTATTATATCAAATTTTTAAATGCTCAGTA
CTATTTGACCATTTAAAAATTTTGTATTCAAACTACCAGTGAAAGCCCT
ACCTAGAAGGTATACTCAGTGATAAGTTTTGTAGCTCCAAATCTTCTAA
TAGTGAGTGTAACCCCAAAATAAAAGGCTGACAGGTAAGTCGAGAATAC
TCACTTAATTCTGGTAAGAAAGCAACCCATTTGTACTTGTATTTACCAG
CAATCCTTAAAATGAAGCTTCCTACTAACTCAATAGCAATAAGACAATA
GTGAATGTTTAATGAAAACAGTATTTTATAAATACTTTAATAAAAAGGA
TTGTGATGAAGAACAATCTATTTATATTTGTTATTTGTTTTTAATTCCA
ATAAAAATAATTTTTAAAATTACAGAAAAAAGTTATTAAGAACCATGCT
TTTAAATTTAAAATGATTTTTTAAATTTATTCCTGTCTTTTTCTACAAA
GAAAGCATACATTAAGCAAATACCAAAGGCCAGGTTTACATTTGAAGAA
AGTGACATTATTATTACTCAAGTCTCTAGGAATACTTAACACATCTCTT
GACTGTATATGGATGTTAATAAATAGCTGACAGTAAAGTTTATCCCATAT
AAAGACTTGCAAATATTCCTCTACCAATGACGAGACTTTAAAATATCTA
TAATAATGTAACACATTTCACTGGTGAAACATGTCTTGTCATATGCATT
ATAGAAAGGATAATCAGACTTTCAGTTATATTAATATTTTTAACATTTT
TGTGCACATAGCTATCTTCAATAAAATTGTTTTAAAAGGTATTATTTTA
AGATACACTAAAATGATCAAGGGATTCAAGACTAAACAACTCAATTAGT
TGCACCAATAAAAAACACTTAAAAAAACTGTCAGTGTCCAACCTGTACT
TAATAACTCACAGATTTTTAAAACTTTTCTTTTCAGGAGAATTTTGGTT
GGGCCTAGAGAAGATATACTCCATAGTGAAGCAATCTAATTATGTTTTA
CGAATTGAGTTGGAAGACTGGAAAGACAACAAACATTATATTGAATATT
CTTTTTACTTGGGAAATCACGAAACCAACTATACGCTACATCTAGTTGC
```

-continued

```
GATTACTGGCAATGTCCCCAATGCAATCCCGGAAAACAAAGATTTGGTG
TTTTCTACTTGGGATCACAAAGCAAAAGGACACTTCAACTGTCCAGAGG
GTTATTCAGGTATCTTTTTCTGATACCAATACTTTATTTTCATATCTTC
AAAGTATCTTCCCACATTATTAGCTATTATCTGCAATGACAACTTTTAA
AAATCCGAATCCCAAATAAGCGTTTTCTCTCTAGACGAAAACCTCTTAA
CTATAATGAAAGTGTTCATTCTAGTTCAATCAGGTATTTTACCTCTAAT
CTTCCTCAGATTTTCTATTTTTTGGTAGTGTATAGATTATTTATACAGA
TTATTTAAAATTGGGACTTATACAGATTATTTAAAACTGGGATACATGC
ATCTAAAACACTGTAATATTTATAAGAAAGGAAGATAAACTTACGGGGA
AATACAGTAACAGTAACTACATACGAGTCTGTACCCATTAAATTGCATA
TCTATCTCCTTTAGGAGGCTGGTGGTGGCATGATGAGTGTGGAGAAAAC
AACCTAAATGGTAAATATAACAAACCAAGAGCAAAATCTAAGCCAGAGA
GGAGAAGAGGATTATCTTGGAAGTCTCAAAATGGAAGGTTATACTCTAT
AAAATCAACCAAAATGTTGATCCATCCAACAGATTCAGAAAGCTTTGAA
TGAACTGAGGCAAATTTAAAAGGCAATAATTTAAACATTAACCTCATTC
CAAGTTAATGTGGTCTAATAATCTGGTATTAAATCCTTAAGAGAAAGCT
TGAGAAATAGATTTTTTTATCTTAAAGTCACTGTCTATTTAAGATTAA
ACATACAATCACATAACCTAAAGAATACCGTTTACATTTCTCAATCAA
AATTCTTATAATACTATTTGTTTAAATTTTGTGATGTGGGAATCAATT
TTAGATGGTCACAATCTAGATTATAATCAATAGGTGAACTTATTAAATA
ACTTTTCTAAATAAAAAATTTAGAGACTTTTATTTTAAAAGGCATCATA
TGAGCTAATATCACAACTTTCCCAGTTTAAAAAACTAGTACTCTTGTTA
AAACTCTAAACTTGACTAAATACAGAGGACTGGTAATTGTACAGTTCTT
AAATGTTGTAGTATTAATTTCAAAACTAAAAATCGTCAGCACAGAGTAT
GTGTAAAAATCTGTAATACAAATTTTTAAACTGATGCTTCATTTTGCTA
CAAAATAATTTGGAGTAAATGTTTGATATGATTTATTTATGAAACCTAA
TGAAGCAGAATTAAATACTGTATTAAAATAAGTTCGCTGTCTTTAAACA
AATGGAGATGACTACTAAGTCACATTGACTTTAACATGAGGTATCACTA
TACCTTATTTGTTAAAATATATACTGTATACATTTTATATATTTTAACA
CTTAATACTATGAAAACAAATAATTGTAAAGGAATCTTGTCAGATTACA
GTAAGAATGAACATATTTGTGGCATCGAGTTAAAGTTTATATTTCCCCT
AAATATGCTGTGATTCTAATACATTCGTGTAGGTTTTCAAGTAGAAATA
AACCTCGTAACAAGTTACTGAACGTTTAAACAGCCTGACAAGCATGTAT
ATATGTTTAAAATTCAATAAACAAAGACCCAGTCCCTAAATTATAGAAA
TTTAAATTATTCTTGCATGTTTATCGACATCACAACAGATCCCTAAATC
CCTAAATCCCTAAAGATTAGATACAAATTTTTACCACAGTATCACTTG
TCAGAATTTATTTTAAATATGATTTTTAAAACTGCCAGTAAGAAATT
TTAAATTAAACCCATTTGTTAAAGGATATAGTGCCCAAGTTATATGGTG
ACCTACCTTTGTCAATACTTAGCATTATGTATTTCAAATTATCCAATAT
ACATGTCATATATATTTTTATATGTCACATATATAAAAGATATGTATGA
TCTATGTGAATCCTAAGTAAATATTTTGTTCCAGAAAAGTACAAAATAA
TAAAGGTAAAAATAATCTATAATTTTCAGGACCACAGACTAAGCTGTCG
AAATTAACGCTGATTTTTTAGGGCCAGAATACCAAATGGCTCCTCTC
TTCCCCCAAAATTGGACAATTTCAAATGCAAAATAATTCATTATTTAAT
ATATGAGTTGCTTCCTCTATTTGGTTTCCTTAAAAAAAAAAAAAACTCT
CATAGGACATGTTTCATTTTGTTCCTTTCAGGAGTAGTAAATTAGACGT
TTTCCCCATATAAAGCTTTTTTCTACCAGAAAGATACTTCTGGTAGAAG
AAGAGAAAGGAGCTCTTTATGGTTCACACGACTGTCTCCTGTCCTAACT
ACTTTGCTTAAAGTGCTCAAATTCCATCACTACTCACAGTTGTCTAATC
TAAGTCTAATCCCCTTTGATCTCTCAGACTACCTTCCCTTTTATCTCTC
TACTACTTAATAATAAGAATATCTTTTTTTCAAACTTGACCTTCATTTT
GCTTTCACAATACTATACTCTCCATGGATTATCCCTTATCTGAATCCAT
CTTTATAACCCTATTCCTTTCTCATATTTAGTACTGTGGGCCAATGGAC
AACCTTCAATCATCTTTTCTACACTGACCCTCAGACATTCTATCTGCTC
TCACGGACTCCTTTATTTACCATGAATAAAGTTCCAAAATCTACATATT
CATCCCAAGTCTCTTTCCAGTTCCCCTTCTTACATTGCCTATTTGCCAT
TTCTCCCTTCAATACCCTATACTTCACTCAAATTCAACATACCAAAAT
AAAAGGCCAGGCACGGTGGCTCACACCTGTAATCCCAGGACTTTGGGAG
GCTGAGGCAGGTGGATCACCTGAGGTCAGGAGTCTGACCAGCCTGACCA
ATATGGTGAAACCCCGTCTCTACCTAAAATACAAAAATTAGCCAGGCGT
GGTGGCATGTGCCTACAGTCCCAGCTACTCAAGAGGCTGAGACAGGAGA
ATCGCTTGAACCCAGGAGGCGGAGGTTGCAGTGAGCTGAGATCACACCA
ATGCACTGGGTGACAGAACAAGACTGACTCAAAAAAAAATAAATAACAA
ATTCCCCAGCCCCTTACTGCTACTGCTATCCCTTTCTACCCACCTTTCC
CTCCTTTATACTCTTTCACACCATCTTCCTCACTTCTTTATATCCATTA
ATATGACCAGCATGTTCCCAGTCACAGAAGCCTGGAACCCGGAAGACAT
CTCTGGCTTTTCACTCAACTTTGTAAACTACCTCTTTTGTATCATAAGC
CACCAAGTTCAATACAATCTTCTCTTGAAACGTCTCTTAATCTTATAAG
CTTTCTTCCCCAAAGACTGTCTTTAACTTCAGTGCTAGATTATATAAGT
```

AAD34156.1 Human Angiopoietin-Related Protein 3

(SEQ ID NO: 8)
MFTIKLLLFIVPLVISSRIDQDNSSFDSLSPEPKSRFAMLDDVKILANG
LLQLGHGLKDFVHKTKGQINDIFQKLNIFDQSFYDLSLQTSEIKEEEKE
LRRTTYKLQVKNEEVKNMSLELNSKLESLLEEKILLQQKVKYLEEQLTN
LIQNQPETPEHPEVTSLKTFVEKQDNSIKDLLQTVEDQYKQLNQQHSQI
KEIENQLRRTSIQEPTEISLSSKPRAPRTTPFLQLNEIRNVKHDGIPAE
CTTIYNRGEHTSGMYAIRPSNSQVFHVYCDVISGSPWTLIQHRIDGSQN
FNETWENYKYGFGRLDGEFWLGLEKIYSIVKQSNYVLRIELEDWKDNKH
YIEYSFYLGNHETNYTLHLVAITGNVPNAIPENKDLVFSTWDHKAKGHF

NCPEGYSGGWWWHDECGENNLNGKYNKPRAKSKPERRRGLSWKSQNGRL
YSIKSTKMLIHPTDSESFE

Lipoprotein (a) (LPA)

In some embodiments, the target gene for modification using the compositions and methods disclosed herein is gene encoding lipoprotein a (LPA). LPA is a low-density lipoprotein variant. Genetic and epidemiologic studies have identified LPA as a risk factor for atherosclerosis and related diseases, such as coronary heart disease and stroke. LPA concentrations vary more than one thousand times between individuals: from <0.2 to >200 mg/dL. This range of concentrations is observed in all populations studied by scientists so far.

The mean and median concentrations between different world populations show distinct particularities, the main being the two to threefold higher LPA plasma concentration of populations of African descent compared to Asian, Oceanic, or European populations. High LPA in blood correlates with coronary heart disease (CHD), cardiovascular disease (CVD), atherosclerosis, thrombosis, and stroke. Individuals without LPA or with very low LPA levels seem to be healthy. Thus, plasma LPA is not vital, at least under normal environmental conditions. Since apo(a)/LPA appeared rather recently in mammalian evolution—only old world monkeys and humans have been shown to harbor LPA—its function might not be vital, but just evolutionarily advantageous under certain environmental conditions, e.g. in case of exposure to certain infectious diseases.

An exemplary LPA amino acid sequence encoded by Human reference sequence NG_016147.1 is provided below:
>sp|P08519|APOA_HUMAN Apolipoprotein(a) OS=Homo sapiens OX=9606 GN=LPA PE=1 SV=1

(SEQ ID NO: 64)
MEHKEVVLLLLLFLKSAAPEQSHVVQDCYHGDGQSYRGTYSTTVTGRTC

QAWSSMTPHQHNRTTENYPNAGLIMNYCRNPDAVAAPYCYTRDPGVRWE

YCNLTQCSDAEGTAVAPPTVTPVPSLEAPSEQAPTEQRPGVQECYHGNG

QSYRGTYSTTVTGRTCQAWSSMTPHSHSRTPEYYPNAGLIMNYCRNPDA

VAAPYCYTRDPGVRWEYCNLTQCSDAEGTAVAPPTVTPVPSLEAPSEQA

PTEQRPGVQECYHGNGQSYRGTYSTTVTGRTCQAWSSMTPHSHSRTPEY

YPNAGLIMNYCRNPDAVAAPYCYTRDPGVRWEYCNLTQCSDAEGTAVAP

PTVTPVPSLEAPSEQAPTEQRPGVQECYHGNGQSYRGTYSTTVTGRTCQ

AWSSMTPHSHSRTPEYYPNAGLIMNYCRNPDAVAAPYCYTRDPGVRWEY

CNLTQCSDAEGTAVAPPTVTPVPSLEAPSEQAPTEQRPGVQECYHGNGQ

SYRGTYSTTVTGRTCQAWSSMTPHSHSRTPEYYPNAGLIMNYCRNPDAV

AAPYCYTRDPGVRWEYCNLTQCSDAEGTAVAPPTVTPVPSLEAPSEQAP

TEQRPGVQECYHGNGQSYRGTYSTTVTGRTCQAWSSMTPHSHSRTPEYY

PNAGLIMNYCRNPDAVAAPYCYTRDPGVRWEYCNLTQCSDAEGTAVAPP

TVTPVPSLEAPSEQAPTEQRPGVQECYHGNGQSYRGTYSTTVTGRTCQA

WSSMTPHSHSRTPEYYPNAGLIMNYCRNPDAVAAPYCYTRDPGVRWEYC

NLTQCSDAEGTAVAPPTVTPVPSLEAPSEQAPTEQRPGVQECYHGNGQS

YRGTYSTTVTGRTCQAWSSMTPHSHSRTPEYYPNAGLIMNYCRNPDAVA

APYCYTRDPGVRWEYCNLTQCSDAEGTAVAPPTVTPVPSLEAPSEQAPT

EQRPGVQECYHGNGQSYRGTYSTTVTGRTCQAWSSMTPHSHSRTPEYYP

NAGLIMNYCRNPDAVAAPYCYTRDPGVRWEYCNLTQCSDAEGTAVAPPT

VTPVPSLEAPSEQAPTEQRPGVQECYHGNGQSYRGTYSTTVTGRTCQAW

SSMTPHSHSRTPEYYPNAGLIMNYCRNPDAVAAPYCYTRDPGVRWEYCN

LTQCSDAEGTAVAPPTVTPVPSLEAPSEQAPTEQRPGVQECYHGNGQSY

RGTYSTTVTGRTCQAWSSMTPHSHSRTPEYYPNAGLIMNYCRNPDAVAA

PYCYTRDPGVRWEYCNLTQCSDAEGTAVAPPTVTPVPSLEAPSEQAPTE

QRPGVQECYHGNGQSYRGTYSTTVTGRTCQAWSSMTPHSHSRTPEYYPN

AGLIMNYCRNPDAVAAPYCYTRDPGVRWEYCNLTQCSDAEGTAVAPPTV

TPVPSLEAPSEQAPTEQRPGVQECYHGNGQSYRGTYSTTVTGRTCQAWS

SMTPHSHSRTPEYYPNAGLIMNYCRNPDAVAAPYCYTRDPGVRWEYCNL

TQCSDAEGTAVAPPTVTPVPSLEAPSEQAPTEQRPGVQECYHGNGQSYR

GTYSTTVTGRTCQAWSSMTPHSHSRTPEYYPNAGLIMNYCRNPDAVAAP

YCYTRDPGVRWEYCNLTQCSDAEGTAVAPPTVTPVPSLEAPSEQAPTEQ

RPGVQECYHGNGQSYRGTYSTTVTGRTCQAWSSMTPHSHSRTPEYYPNA

GLIMNYCRNPDAVAAPYCYTRDPGVRWEYCNLTQCSDAEGTAVAPPTVT

PVPSLEAPSEQAPTEQRPGVQECYHGNGQSYRGTYSTTVTGRTCQAWSS

MTPHSHSRTPEYYPNAGLIMNYCRNPDAVAAPYCYTRDPGVRWEYCNLT

QCSDAEGTAVAPPTVTPVPSLEAPSEQAPTEQRPGVQECYHGNGQSYRG

TYSTTVTGRTCQAWSSMTPHSHSRTPEYYPNAGLIMNYCRNPDAVAAPY

CYTRDPGVRWEYCNLTQCSDAEGTAVAPPTVTPVPSLEAPSEQAPTEQR

PGVQECYHGNGQSYRGTYSTTVTGRTCQAWSSMTPHSHSRTPEYYPNAG

LIMNYCRNPDAVAAPYCYTRDPGVRWEYCNLTQCSDAEGTAVAPPTVTP

VPSLEAPSEQAPTEQRPGVQECYHGNGQSYRGTYSTTVTGRTCQAWSSM

TPHSHSRTPEYYPNAGLIMNYCRNPDAVAAPYCYTRDPGVRWEYCNLTQ

CSDAEGTAVAPPTVTPVPSLEAPSEQAPTEQRPGVQECYHGNGQSYRGT

YSTTVTGRTCQAWSSMTPHSHSRTPEYYPNAGLIMNYCRNPDAVAAPYC

YTRDPGVRWEYCNLTQCSDAEGTAVAPPTVTPVPSLEAPSEQAPTEQRP

GVQECYHGNGQSYRGTYSTTVTGRTCQAWSSMTPHSHSRTPEYYPNAGL

IMNYCRNPDAVAAPYCYTRDPGVRWEYCNLTQCSDAEGTAVAPPTVTPV

PSLEAPSEQAPTEQRPGVQECYHGNGQSYRGTYSTTVTGRTCQAWSSMT

PHSHSRTPEYYPNAGLIMNYCRNPDAVAAPYCYTRDPGVRWEYCNLTQC

SDAEGTAVAPPTVTPVPSLEAPSEQAPTEQRPGVQECYHGNGQSYRGTY

STTVTGRTCQAWSSMTPHSHSRTPEYYPNAGLIMNYCRNPDAVAAPYCY

TRDPGVRWEYCNLTQCSDAEGTAVAPPTVTPVPSLEAPSEQAPTEQRPG

VQECYHGNGQSYRGTYSTTVTGRTCQAWSSMTPHSHSRTPEYYPNAGLI

MNYCRNPDAVAAPYCYTRDPGVRWEYCNLTQCSDAEGTAVAPPTVTPVP

SLEAPSEQAPTEQRPGVQECYHGNGQSYRGTYSTTVTGRTCQAWSSMTP

HSHSRTPEYYPNAGLIMNYCRNPDAVAAPYCYTRDPGVRWEYCNLTQCS

-continued

DAEGTAVAPPTVTPVPSLEAPSEQAPTEQRPGVQECYHGNGQSYRGTYS

TTVTGRTCQAWSSMTPHSHSRTPEYYPNAGLIMNYCRNPDAVAAPYCYT

RDPGVRWEYCNLTQCSDAEGTAVAPPTVTPVPSLEAPSEQAPTEQRPGV

QECYHGNGQSYRGTYSTTVTGRTCQAWSSMTPHSHSRTPEYYPNAGLIM

NYCRNPDAVAAPYCYTRDPGVRWEYCNLTQCSDAEGTAVAPPTVTPVPS

LEAPSEQAPTEQRPGVQECYHGNGQSYRGTYSTTVTGRTCQAWSSMTPH

SHSRTPEYYPNAGLIMNYCRNPDAVAAPYCYTRDPGVRWEYCNLTQCSD

AEGTAVAPPTVTPVPSLEAPSEQAPTEQRPGVQECYHGNGQSYRGTYST

TVTGRTCQAWSSMTPHSHSRTPEYYPNAGLIMNYCRNPDAVAAPYCYTR

DPGVRWEYCNLTQCSDAEGTAVAPPTVTPVPSLEAPSEQAPTEQRPGVQ

ECYHGNGQSYRGTYSTTVTGRTCQAWSSMTPHSHSRTPEYYPNAGLIMN

YCRNPDPVAAPYCYTRDPSVRWEYCNLTQCSDAEGTAVAPPTITPIPSL

EAPSEQAPTEQRPGVQECYHGNGQSYQGTYFITVTGRTCQAWSSMTPHS

HSRTPAYYPNAGLIKNYCRNPDPVAAPWCYTTDPSVRWEYCNLTRCSDA

EWTAFVPPNVILAPSLEAFFEQALTEETPGVQDCYYHYGQSYRGTYSTT

VTGRTCQAWSSMTPHQHSRTPENYPNAGLTRNYCRNPDAEIRPWCYTMD

PSVRWEYCNLTQCLVTESSVLATLTVVPDPSTEASSEEAPTEQSPGVQD

CYHGDGQSYRGSFSTTVTGRTCQSWSSMTPHWHQRTTEYYPNGGLTRNY

CRNPDAEISPWCYTMDPNVRWEYCNLTQCPVTESSVLATSTAVSEQAPT

EQSPTVQDCYHGDGQSYRGSFSTTVTGRTCQSWSSMTPHWHQRTTEYYP

NGGLTRNYCRNPDAEIRPWCYTMDPSVRWEYCNLTQCPVMESTLLTTPT

VVPVPSTELPSEEAPTENSTGVQDCYRGDGQSYRGTLSTTITGRTCQSW

SSMTPHWHRRIPLYYPNAGLTRNYCRNPDAEIRPWCYTMDPSVRWEYCN

LTRCPVTESSVLTTPTVAPVPSTEAPSEQAPPEKSPVVQDCYHGDGRSY

RGISSTTVTGRTCQSWSSMIPHWHQRTPENYPNAGLTENYCRNPDSGKQ

PWCYTTDPCVRWEYCNLTQCSETESGVLETPTVVPVPSMEAHSEAAPTE

QTPVVRQCYHGNGQSYRGTFSTTVTGRTCQSWSSMTPHRHQRTPENYPN

DGLTMNYCRNPDADTGPWCFTMDPSIRWEYCNLTRCSDTEGTVVAPPTV

IQVPSLGPPSEQDCMFGNGKGYRGKKATTVTGTPCQEWAAQEPHRHSTF

IPGTNKWAGLEKNYCRNPDGDINGPWCYTMNPRKLFDYCDIPLCASSSF

DCGKPQVEPKKCPGSIVGGCVAHPHSWPWQVSLRTRFGKHFCGGTLISP

EWVLTAAHCLKKSSRPSSYKVILGAHQEVNLESHVQEIEVSRLFLEPTQ

ADIALLKLSRPAVITDKVMPACLPSPDYMVTARTECYITGWGETQGTFG

TGLLKEAQLLVIENEVCNHYKYICAEHLARGTDSCQGDSGGPLVCFEKD

KYILQGVTSWGLGCARPNKPGVYARVSRFVTWIEGMMRNN

Base Editor Protein-2RNA Complexes

In another aspect, provided herein is a complex comprising the single guide RNA as provided herein in complex with the base editor fusion protein, e.g. the adenosine base editor fusion protein, wherein the complex comprises increased stability as compared to a complex with an unmodified single guide RNA and a base editor protein, wherein the stability is measured by half life of the complex ex vivo or in vitro.

In some embodiments, the complex comprises increased stability as compared to a complex with an unmodified single guide RNA and a Cas9 protein. In some embodiments, the complex comprises increased stability by at least 5%, at least 10%, at least 20%, at least 30%, at least 40%, at least 50%, at least 60%, at least 70%, at least 80%, at least 90%, at least 100%, at least 200%, at least 300%, at least 400%, at least 500%, at least 600%, at least 700%, at least 800%, at least 900%, at least 1000%, at least 2000%, at least 3000%, at least 4000%, at least 5000%, at least 6000%, at least 7000%, at least 8000%, at least 9000%, at least 10000%, at least 20000%, at least 30000%, at least 40000%, at least 50000%, at least 60000%, at least 70000%, at least 80000%, at least 90000%, or at least 100000% as compared to a complex with an unmodified single guide RNA and a Cas9 protein. In some embodiments, the complex comprises increased stability by at least 2 fold, at least 3 fold, at least 4 fold, at least 5 fold, at least 10 fold, at least 20 fold, at least 25 fold, at least 30 fold, at least 40 fold, at least 50 fold, at least 60 fold, at least 70 fold, at least 80 fold, at least 90 fold, at least 100 fold, at least 200 fold, at least 300 fold, at least 400 fold, at least 500 fold, at least 600 fold, at least 700 fold, at least 800 fold, at least 900 fold, at least 1000 fold, at least 2000 fold, at least 3000 fold, at least 4000 fold, at least 5000 fold, at least 6000 fold, at least 7000 fold, at least 8000 fold, at least 9000 fold, or at least 10000 fold as compared to a complex with an unmodified single guide RNA and a Cas9 protein.

In some embodiments, wherein the stability of the complex is measured by half life of the complex. In some embodiments, wherein the stability of the complex is measured by half life of the complex ex vivo. In some embodiments, wherein the stability of the complex is measured by half life of the complex in vitro.

In some embodiments, the complex comprises increased half life by at least 5%, at least 10%, at least 20%, at least 30%, at least 40%, at least 50%, at least 60%, at least 70%, at least 80%, at least 90%, at least 100%, at least 200%, at least 300%, at least 400%, at least 500%, at least 600%, at least 700%, at least 800%, at least 900%, at least 1000%, at least 2000%, at least 3000%, at least 4000%, at least 5000%, at least 6000%, at least 7000%, at least 8000%, at least 9000%, at least 10000%, at least 20000%, at least 30000%, at least 40000%, at least 50000%, at least 60000%, at least 70000%, at least 80000%, at least 90000%, or at least 100000% as compared to a complex with an unmodified single guide RNA and a Cas9 protein wherein half life of the complex is measured ex vivo. In some embodiments, the single guide RNA exhibits increased half life of the complex by at least 2 fold, at least 3 fold, at least 4 fold, at least 5 fold, at least 10 fold, at least 20 fold, at least 25 fold, at least 30 fold, at least 40 fold, at least 50 fold, at least 60 fold, at least 70 fold, at least 80 fold, at least 90 fold, at least 100 fold, at least 200 fold, at least 300 fold, at least 400 fold, at least 500 fold, at least 600 fold, at least 700 fold, at least 800 fold, at least 900 fold, at least 1000 fold, at least 2000 fold, at least 3000 fold, at least 4000 fold, at least 5000 fold, at least 6000 fold, at least 7000 fold, at least 8000 fold, at least 9000 fold, or at least 10000 fold as compared to a complex with an unmodified single guide RNA and a Cas9 protein, wherein half life of the complex is measured ex vivo.

In some embodiments, the complex comprises increased half life when measured in vitro by at least 5%, at least 10%, at least 20%, at least 30%, at least 40%, at least 50%, at least 60%, at least 70%, at least 80%, at least 90%, at least 100%, at least 200%, at least 300%, at least 400%, at least 500%, at least 600%, at least 700%, at least 800%, at least 900%, at least 1000%, at least 2000%, at least 3000%, at least 4000%, at least 5000%, at least 6000%, at least 7000%, at least 8000%, at least 9000%, at least 10000%, at least 20000%, at least 30000%, at least 40000%, at least 50000%, at least 60000%, at least 70000%, at least 80000%, at least 90000%, or at least 100000% as compared to a complex with an unmodified single guide RNA and a Cas9 protein, wherein half life of the complex is measured in vitro. In some embodiments, the single guide RNA exhibits increased half life of the complex by at least 2 fold, at least 3 fold, at least 4 fold, at least 5 fold, at least 10 fold, at least 20 fold, at least 25 fold, at least 30 fold, at least 40 fold, at least 50 fold, at least 60 fold, at least 70 fold, at least 80 fold, at least 90 fold, at least 100 fold, at least 200 fold, at least 300 fold, at least 400 fold, at least 500 fold, at least 600 fold, at least 700 fold, at least 800 fold, at least 900 fold, at least 1000 fold, at least 2000 fold, at least 3000 fold, at least 4000 fold, at least 5000 fold, at least 6000 fold, at least 7000 fold, at least 8000 fold, at least 9000 fold, or at least 10000 fold as compared to a complex with an unmodified single guide RNA and a Cas9 protein, wherein half life of the complex is measured in vitro.

In another aspect, provided herein is a cell comprising the complex as provided herein. In some embodiments, the cell may be an in vitro cell. In some embodiments, the cell may be an ex vivo cell. In some embodiments, the cell may be an in vivo cell. In some embodiments, the cell may be an isolated cell.

Gene Modification Compositions

In another aspect, provided herein is a composition for gene modification comprising the single guide RNA as provided herein and a base editor protein or a nucleic acid sequence encoding the base editor protein. In some embodiments, the composition further comprises a vector that comprises the nucleic acid sequence encoding the base editor protein.

In some embodiments, the nucleic acid sequence may be a DNA, an RNA or mRNA, or a modified nucleic acid sequence. In some embodiments, the vector may be an expression vector. In some embodiments, the nucleic acid is operatively linked to a promoter of the vector. In some embodiments, the vector is a plasmid or a viral vector.

Therapeutics and Methods of Treatment

In some aspects, provided herein is a method for treating or preventing a condition in a subject in need thereof, the method comprising administering to the subject a therapeutically effective amount of (i) a guide polynucleotide or a nucleic acid encoding same, and (ii) a base editor fusion protein comprising a programmable DNA binding domain and a deaminase, or a nucleic acid encoding same. In some embodiments, the base editor system comprises a guide polynucleotide. In some embodiments, the base editor system comprises a nucleic acid encoding a guide polynucleotide. In some embodiments, the base editor system comprises a base editor fusion protein comprising a programmable DNA binding domain and a deaminase. In some embodiments, the base editor system comprises a nucleic acid encoding a base editor fusion protein comprising a programmable DNA binding domain and a deaminase.

In some embodiments, the guide polynucleotide directs the base editor system to effect a nucleobase alteration in a ANGPTL3 gene in the subject. In some embodiments, the guide polynucleotide directs the base editor system to effect a nucleobase alteration in a PCSK9gene in the subject.

In some embodiments, the base alteration occurs in at least 35% of whole liver cells in the subject as measured by next generation sequencing or Sanger sequencing, thereby treating or preventing the condition in the subject.

In some aspects, provided herein is a method for treating or preventing a condition in a subject in need thereof, the method comprising administering to the subject a therapeutically effective amount of a first composition, comprising (i) a guide polynucleotide or a nucleic acid encoding same, and (ii) a base editor fusion protein comprising a programmable DNA binding domain and a deaminase, or a nucleic acid encoding same, wherein the guide polynucleotide directs the base editor system to effect a nucleobase alteration in a PCSK9 gene in the subject, wherein the base alteration occurs in at least 35% of whole liver cells in the subject as measured by next generation sequencing or Sanger sequencing; and a second composition, comprising (i) a guide polynucleotide or a nucleic acid encoding same, and (ii) a base editor fusion protein comprising a programmable DNA binding domain and a deaminase, or a nucleic acid encoding same, wherein the guide polynucleotide directs the base editor system to effect a nucleobase alteration in a ANGPTL3 gene in the subject, wherein the base alteration occurs in at least 35% of whole liver cells in the subject as measured by next generation sequencing or Sanger sequencing.

In some embodiments, the first composition and the second composition are administered sequentially. In some embodiment, the first composition is administered for one or more doses, then the second composition is administered for one or more doses. In some embodiments, the first composition and the second composition interspersed. In some embodiments, the first composition and the second composition are administered concurrently. In some embodiments, the first composition and the second composition are administered for one or more doses. In some embodiments, the first composition and the second composition are administered over and interval of over an interval of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 hours.

In some embodiments, the first composition and the second composition are administered over and interval of over an interval of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 days. In some embodiments, the first composition and the second composition are administered over and interval of over an interval of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 weeks.

In some embodiments, the base alteration occurs in at least 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% of whole liver cells in the subject as measured by next generation sequencing or Sanger sequencing. In some embodiments, the base alteration occurs in at most 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% of whole liver cells in the subject as measured by next generation sequencing or Sanger sequencing. In some embodiments, the base alteration occurs in 1%-99.9%, 2%-99.9%, 3%-99.9%, 4%-99.9%, 5%-99.9%, 6%-99.9%, 7%-99.9%, 8%-99.9%, 9%-99.9%, 10%-99.9%, 15%-99.9%, 20%-99.9%, 25%-99.9%, 30%-99.9%, 35%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% of whole liver cells in the subject as measured by next generation sequencing or Sanger sequencing. In some embodiments, the base alteration occurs in 1%-990.5%, 1%-99%, 1%-98%, 1%-97%, 1%-96%, 1%-95%, 1%-90%, 1%-85%, 1%-80%, 1%-75%, 1%-70%, 1%-65%, 1%-60%, 1%-55%, 1%-50%, 1%-45%, 1%-40%, 1%-35%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% of whole liver cells in the subject as measured by next generation sequencing or Sanger sequencing. In some embodiments, the base alteration occurs in 1%-90%, 5%-85%, 10%-80%, 15%-75%, 20%-70%, 25%-65%, 30%-60%, 35%-55%, or 40%-50% of whole liver cells in the subject as measured by next generation sequencing or Sanger sequencing. In some embodiments, the base alteration occurs in 100% of whole liver cells in the subject as measured by next generation sequencing or Sanger sequencing.

In some embodiments, the base alteration occurs in hepatocytes in the subject. In some embodiments, the base alteration occurs in at least 30% of hepatocytes in the subject as measured by next generation sequencing or Sanger sequencing. In some embodiments, the base alteration occurs in hepatocytes in the subject. In some embodiments, the base alteration occurs in at least 35% of hepatocytes in the subject as measured by next generation sequencing or Sanger sequencing. In some embodiments, the base alteration occurs in at least 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% of hepatocytes in the subject as measured by next generation sequencing or Sanger sequencing. In some embodiments, the base alteration occurs in at most 1%, 2%, 3%, 4%, 5%0, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% of hepatocytes in the subject as measured by next generation sequencing or Sanger sequencing. In some embodiments, the base alteration occurs in 1%-99.9%, 2%-99.9%, 3%-99.9%, 4%-99.9%, 5%-99.9%, 6%-99.9%, 7%-99.9%, 8%-99.9%, 9%-99.9%, 100%-99.9%, 15%-99.9%, 20%-99.9%, 25%-99.9%, 30%-99.9%, 35%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% of hepatocytes in the subject as measured by next generation sequencing or Sanger sequencing. In some embodiments, the base alteration occurs in 1%-99.5%, 1%-99%, 1%-98%, 1%-97%, 1%-96%, 1%-95%, 1%-90%, 1%-85%, 1%-80%, 1%-75%, 1%-70%, 1%-65%, 1%-60%, 1%-55%, 1%-50%, 1%-45%, 1%-40%, 1%-35%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% hepatocytes in the subject as measured by next generation sequencing or Sanger sequencing. In some embodiments, the base alteration occurs in 1%-90%, 5%-85%, 10%-80%, 15%-75%, 20%-70%, 25%-65%, 30%-60%, 35%-55%, or 40%-50% of hepatocytes in the subject as measured by next generation sequencing or Sanger sequencing. In some embodiments, the base alteration occurs in 100% of hepatocytes in the subject as measured by next generation sequencing or Sanger sequencing.

In some embodiments, the base alteration occurred in whole liver cells in the subject is measured by next generation sequencing. In some embodiments, the base alteration occurred in whole liver cells in the subject is measured by Sanger sequencing. In some embodiments, the base alteration occurred in hepatocytes in the subject is measured by next generation sequencing. In some embodiments, the base alteration occurred in hepatocytes in the subject is measured by Sanger sequencing.

In some embodiments, the method for treating or preventing a condition in a subject in need thereof as described herein comprises administering (i) the guide polynucleotide and (ii) the nucleic acid encoding the base editor fusion protein to the subject. In some embodiments, the base editor system comprises a guide polynucleotide. In some embodiments, the base editor system comprises a nucleic acid encoding a guide polynucleotide.

In some embodiments, the nucleic acid encoding the base editor fusion protein is a mRNA. In some embodiments, the mRNA generates the base editor fusion protein upon translation in the subject after the administration. In some embodiments, the base editor fusion protein forms a RNP complex in the subject.

In some embodiments, the method for treating or preventing a condition in a subject in need thereof as described herein further comprises administering a lipid nanoparticle (LNP) enclosing a guide polynucleotide or a nucleic acid encoding the guide polynucleotide (i). In some embodiments, the method for treating or preventing a condition in a subject in need thereof as described herein further comprises administering a second LNP enclosing a base editor fusion protein comprising a programmable DNA binding domain and a deaminase, or a nucleic acid encoding same (ii). In some embodiments, the method for treating or preventing a condition in a subject in need thereof as described herein further comprises administering a LNP enclosing a guide polynucleotide or a nucleic acid encoding the guide polynucleotide (i) and a base editor fusion protein comprising a programmable DNA binding domain and a deaminase, or a nucleic acid encoding same (ii). In some embodiments, the RNP complex is formed upon uptake of the LNP or the second LNP by a liver cell in the subject.

In some embodiments, the ratio of a guide polynucleotide or a nucleic acid encoding the guide polynucleotide (i) and a base editor fusion protein comprising a programmable DNA binding domain and a deaminase, or a nucleic acid encoding same (ii) is about 1:10 to about 10:1 by weight. In some embodiments, the ratio of the guide polynucleotide and the nucleic acid encoding the base editor fusion protein is about 1:1, 1.5:1, 2:1, 3:1, 4:1, 1:1.5, 1:2, 1:3, or 1:4 by weight. In some embodiments, the molar ratio of the guide polynucleotide and the nucleic acid encoding the base editor fusion protein is about 500:1 to about 1:500.

In some embodiments, the ratio of the guide polynucleotide and the nucleic acid encoding the base editor fusion protein is about 1000:1 to about 1:1000 by weight. In some embodiments, the ratio of the guide polynucleotide and the nucleic acid encoding the base editor fusion protein is about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of the guide polynucleotide and the nucleic acid encoding the base editor fusion protein is about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight. In some embodiments, the ratio of the guide polynucleotide and the nucleic acid encoding the base editor fusion protein is at least about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of the guide polynucleotide and the nucleic acid encoding the base editor fusion protein is at least about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight. In some embodiments, the ratio of the guide polynucleotide and the nucleic acid encoding the base editor fusion protein is at most about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of the guide polynucleotide and the nucleic acid encoding the base editor fusion protein is at most about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight.

In some embodiments, the molar ratio of the guide polynucleotide and the nucleic acid encoding the base editor fusion protein is about 10000:1 to about 1:10000. In some embodiments, the molar ratio of the guide polynucleotide and the nucleic acid encoding the base editor fusion protein is about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of the guide polynucleotide and the nucleic acid encoding the base editor fusion protein is at least about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1. In some embodiments, the molar ratio of the guide polynucleotide and the nucleic acid encoding the base editor fusion protein is at least about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of the guide polynucleotide and the nucleic acid encoding the base editor fusion protein is at most about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1.

In some embodiments, the ratio of a nucleic acid encoding the guide polynucleotide and the nucleic acid encoding the base editor fusion protein is about 10:1 to about 1:10 by weight. In some embodiments, the ratio of a nucleic acid encoding the guide polynucleotide and the nucleic acid encoding the base editor fusion protein is about 4:1, 3:1, 2:1, 1.5:1, 1:1, 1:1.5, 1:2, 1:3, or 1:4 by weight. In some embodiments, the molar ratio of a nucleic acid encoding the guide polynucleotide and the nucleic acid encoding the base editor fusion protein is about 500:1 to about 1:500.

In some embodiments, the ratio of a nucleic acid encoding the guide polynucleotide and the nucleic acid encoding the base editor fusion protein is about 1000:1 to about 1:1000 by weight. In some embodiments, the ratio of a nucleic acid encoding the guide polynucleotide and the nucleic acid encoding the base editor fusion protein is about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of a nucleic acid encoding the guide polynucleotide and the nucleic acid encoding the base editor fusion protein is about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight. In some embodiments, the ratio of a nucleic acid encoding the guide polynucleotide and the nucleic acid encoding the base editor fusion protein is at least about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of a nucleic acid encoding the guide polynucleotide and the nucleic acid encoding the base editor fusion protein is at least about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight. In some embodiments, the ratio of a nucleic acid encoding the guide polynucleotide and the nucleic acid encoding the base editor fusion protein is at most about 1000:1, 950:1, 900:1, 850:1, 800:1, 750:1, 700:1, 650:1, 600:1, 550:1, 500:1, 450:1, 400:1, 350:1, 300:1, 250:1, 200:1, 100:1, 95:1, 90:1, 85:1, 80:1, 75:1, 70:1, 65:1, 60:1, 55:1, 50:1, 45:1, 40:1, 35:1, 30:1, 25:1, 20:1, 19:1, 18:1, 17:1, 17:1, 15:1, 14:1, 13:1, 12:1, 11:1, 10:1, 9:1, 8:1, 7:1, 6:1, 5:1, 4:1, 3:1, 2:1, 1.9:1, 1.8:1, 1.7:1, 1.6:1, 1.5:1, 1.4:1, 1.3:1, 1.2:1, 1.1:1, 1.0:1, 0.9:1, 0.8:1, 0.7:1, 0.6:1, 0.5:1, 0.4:1, 0.3:1, 0.2:1, or 0.1 by weight. In some embodiments, the ratio of a nucleic acid encoding the guide polynucleotide and the nucleic acid encoding the base editor fusion protein is at most about 1:0.1, 1:0.2, 1:0.3, 1:0.4, 1:0.5, 1:0.6, 1:0.7, 1:0.8, 1:0.9, 1:1.0, 1:1.1, 1:1.2, 1:1.3, 1:1.4, 1:1.5, 1:1.6, 1:1.7, 1:1.8, 1:1.9, 1:2, 1:3, 1:4, 1:5, 1:6, 1:7, 1:8, 1:9, 1:10, 1:11, 1:12, 1:13, 1:14, 1:15, 1:16, 1:17, 1:18, 1:19, 1:20, 1:25, 1:30, 1:35, 1:40, 1:45, 1:50, 1:55, 1:60, 1:65, 1:70, 1:75, 1:80, 1:85, 1:90, 1:95, 1:100, 1:150, 1:200, 1:250, 1:300, 1:350, 1:400, 1:450, 1:500, 1:550, 1:600, 1:650, 1:700, 1:750, 1:800, 1:850, 1:900, 1:950, or 1:1000 by weight.

In some embodiments, the molar ratio of a nucleic acid encoding the guide polynucleotide and the nucleic acid encoding the base editor fusion protein is about 10000:1 to about 1:10000. In some embodiments, the molar ratio of a nucleic acid encoding the guide polynucleotide and the nucleic acid encoding the base editor fusion protein is about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of a nucleic acid encoding the guide polynucleotide and the nucleic acid encoding the base editor fusion protein is at least about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1. In some embodiments, the molar ratio of a nucleic acid encoding the guide polynucleotide and the nucleic acid encoding the base editor fusion protein is at least about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of a nucleic acid encoding the guide polynucleotide and the nucleic acid encoding the base editor fusion protein is at least about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1. In some embodiments, the molar ratio of a nucleic acid encoding the guide polynucleotide and the nucleic acid encoding the base editor fusion protein is at most about 10000:1, 9500:1, 9000:1, 8500:1, 8000:1, 7500:1, 7000:1, 6500:1, 6000:1, 5500:1, 5000:1, 4500:1, 4000:1, 3500:1, 3000:1, 2500:1, 2000:1, 1500:1, 1000:1, 950:1, 900:1, 850:1, 800:1, 750:1, 700:1, 650:1, 600:1, 550:1, 500:1, 450:1, 400:1, 350:1, 300:1, 250:1, 200:1, 190:1, 180:1, 170:1, 160:1, 150:1, 140:1, 130:1, 120:1, 110:1, 100:1, 95:1, 90:1, 85:1, 80:1, 75:1, 70:1, 69:1, 68:1, 67:1, 66:1, 65:1, 64:1, 63:1, 62:1, 61:1, 60:1, 59:1, 58:1, 57:1, 56:1, 55:1, 54:1, 53:1, 52:1, 51:1, 50:1, 49:1, 48:1, 47:1, 46:1, 45:1, 44:1, 43:1, 42:1, 41:1, 40:1, 39:1, 38:1, 37:1, 36:1, 35:1, 34:1, 33:1, 32:1, 31:1, 30:1, 29:1, 28:1, 27:1, 26:1, 25:1, 24:1, 23:1, 22:1, 21:1, 20:1, 19:1, 18:1, 17:1, 16:1, 15:1, 14:1, 13:1, 12:1, 11:1, 10:1, 9:1, 8:1, 7:1, 6:1, 5:1, 4:1, 3:1, 2:1, 1:1, 0.9:1, 0.8:1, 0.7:1, 0.6:1, 0.5:1, 0.4:1, 0.3:1, 0.2:1, or 0.1:1. In some embodiments, the molar ratio of a nucleic acid encoding the guide polynucleotide and the nucleic acid encoding the base editor fusion protein is at most about 1:10000, 1:9500, 1:9000, 1:8500, 1:8000, 1:7500, 1:7000, 1:6500, 1:6000, 1:5500, 1:5000, 1:4500, 1:4000, 1:3500, 1:3000, 1:2500, 1:2000, 1:1500, 1:1000, 1:950, 1:900, 1:850, 1:800, 1:750, 1:700, 1:650, 1:600, 1:550, 1:500, 1:450, 1:400, 1:350, 1:300, 1:250, 1:200, 1:190, 1:180, 1:170, 1:160, 1:150, 1:140, 1:130, 1:120, 1:110, 1:100, 1:95, 1:90, 1:85, 1:80, 1:75, 1:70, 1:69, 1:68, 1:67, 1:66, 1:65, 1:64, 1:63, 1:62, 1:61, 1:60, 1:59, 1:58, 1:57, 1:56, 1:55, 1:54, 1:53, 1:52, 1:51, 1:50, 1:49, 1:48, 1:47, 1:46, 1:45, 1:44, 1:43, 1:42, 1:41, 1:40, 1:39, 1:38, 1:37, 1:36, 1:35, 1:34, 1:33, 1:32, 1:31, 1:30, 1:29, 1:28, 1:27, 1:26, 1:25, 1:24, 1:23, 1:22, 1:21, 1:20, 1:19, 1:18, 1:17, 1:16, 1:15, 1:14, 1:13, 1:12, 1:11, 1:10, 1:9, 1:8, 1:7, 1:6, 1:5, 1:4, 1:3, 1:2, 1:1, 1:0.9, 1:0.8, 1:0.7, 1:0.6, 1:0.5, 1:0.4, 1:0.3, 1:0.2, or 1:0.1.

In some embodiments, the nucleobase alteration results in a reduction of at least 35% in blood PCSK9 protein level in the subject as compared to prior to the administration as measured by ELISA, Western blots, or LC-MS/MS.

In some embodiments, the nucleobase alteration results in a reduction of at least 30%, 35%, 40%, 45%, 50%, 55%, 60%, 65%, 70%, 75%, 80%, 85%, 90%, 95%, 97%, 98%, or 99% in blood PCSK9 protein level in the subject as compared to prior to the administration as measured by ELISA, Western blots, or LC-MS/MS.

In some embodiments, the nucleobase alteration results in a reduction of at least 1%, 2%, 3%, 4%, 5%, 6%, 7%, 8%, 9%, 10%, 15%, 20%, 25%, 30%, 31%, 32%, 33%, 34%, 35%, 36%, 37%, 38%, 39%, 40%, 45%, 50%, 55%, 60%, 65%, 70%, 71%, 72%, 73%, 74%, 75%, 76%, 77%, 78%, 79%, 80%, 85%, 90%, 95%, 97%, 98%, 90%, 95%, 97%, 98%, 99%, 99.3%, 99.5%, 99.7%, 99.8%, or 99.9% in blood PCSK9 protein level in the subject as compared to prior to the administration as measured by ELISA, Western blots, or LC-MS/MS. In some embodiments, the nucleobase alteration results in a reduction of at most 1%, 2%, 3%, 4%, 5%, 6%, 7%, 8%, 9%, 10%, 15%, 20%, 25%, 30%, 31%, 32%, 33%, 34%, 35%, 36%, 37%, 38%, 39%, 40%, 45%, 50%, 55%, 60%, 65%, 70%, 71%, 72%, 73%, 74%, 75%, 76%, 77%, 78%, 79%, 80%, 85%, 90%, 95%, 97%, 98%, 90%, 95%, 97%, 98%, 99%, 99.3%, 99.5%, 99.7%, 99.8%, or 99.9% in blood PCSK9 protein level in the subject as compared to prior to the administration as measured by ELISA, Western blots, or LC-MS/MS. In some embodiments, the nucleobase alteration results in a reduction of 1%-99.9%, 2%-99.9%, 3%-99.9%, 4%-99.9%, 5%-99.9%, 6%-99.9%, 7%-99.9%, 8%-99.9%, 9%-99.9%, 10%-99.9%, 15%-99.9%, 20%-99.9%, 25%-99.9%, 30%-99.9%, 31%-99.9%, 32%-99.9%, 33%-99.9%, 34%-99.9%, 35%-99.9%, 36%-99.9%, 37%-99.9%, 38%-99.9%, 39%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% in blood PCSK9 protein level in the subject as compared to prior to the administration as measured by ELISA, Western blots, or LC-MS/MS. In some embodiments, the nucleobase alteration results in a reduction of 1%-99.5%, 1%-99%, 1%-98%, 1%-97%, 1%-96%, 1%-95%, 1%-90%, 1%-85%, 1%-80%, 1%-79%, 1%-78%, 1%-77%, 1%-76%, 1%-75%, 1%-74%, 1%-73%, 1%-72%, 1%-71%, 1%-70%, 1%-65%, 1%-60%, 1%-55%, 1%-50%, 1%-45%, 1%-40%, 1%-39%, 1%-38%, 1%-37%, 1%-36%, 1%-35%, 1%-34%, 1%-33%, 1%-32%, 1%-31%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% in blood PCSK9 protein level in the subject as compared to prior to the administration as measured by ELISA, Western blots, or LC-MS/MS. In some embodiments, the nucleobase alteration results in a reduction of 1%-99.9%, 5%-99.5%, 10%-99%, 15%-97%, 20%-95%, 25%-90%, 30%-85%, 31%-80%, 32%-79%, 33%-78%, 34%-77%, 35%-76%, 36%-76%, 37%-75%, 38%-74%, 39%-73%, 40%-72%, 45%-71%, 50%-70%, or 55%-65% in blood PCSK9 protein level in the subject as compared to prior to the administration as measured by ELISA, Western blots, or LC-MS/MS. In some embodiments, the nucleobase alteration results in a reduction of 100% in blood PCSK9 protein level in the subject as compared to prior to the administration as measured by ELISA, Western blots, or LC-MS/MS.

In some embodiments, the nucleobase alteration results in at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, 1000% less blood PCSK9 protein level in the subject as compared to prior to the administration as measured by ELISA, Western blots, or LC-MS/MS. In some embodiments, the nucleobase alteration results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less blood PCSK9 protein level in the subject as compared to prior to the administration as measured by ELISA, Western blots, or LC-MS/MS.

In some embodiments, the reduction of blood PCSK9 protein level or the blood PCSK9 protein level in the subject as compared to prior to the administration is measured by ELISA (enzyme-linked immunosorbent assay). In some embodiments, the reduction of blood PCSK9 protein level or the blood PCSK9 protein level in the subject as compared to prior to the administration is measured by Western blot analysis. In some embodiments, the reduction of blood PCSK9 protein level or the blood PCSK9 protein level in the subject as compared to prior to the administration is measured by LC-MS/MS (liquid chromatography-tandem mass spectrometry).

In some embodiments, the nucleobase alteration results in a reduction of at least 35% in blood ANGPTL3 protein level in the subject as compared to prior to the administration as measured by ELISA, Western blots, or LC-MS/MS.

In some embodiments, the nucleobase alteration results in a reduction of at least 30%, 35%, 40%, 45%, 50%, 55%, 60%, 65%, 70%, 75%, 80%, 85%, 90%, 95%, 97%, 98%, or 99% in blood ANGPTL3 protein level in the subject as compared to prior to the administration as measured by ELISA, Western blots, or LC-MS/MS.

In some embodiments, the nucleobase alteration results in a reduction of at least 1%, 2%, 3%, 4%, 5%, 6%, 7%, 8%, 9%, 10%, 15%, 210, 25%, 30, 31%, 32%, 33%, 34%, 35%, 36%, 37%, 38%, 39%, 40%, 45%, 50%, 55%, 60%, 65%, 70%, 71%, 72%, 73%, 74%, 75%, 76%, 77%, 78%, 79%, 80%, 85%, 90%, 95%, 97%, 98%, 90%, 95%, 97%, 98%, 99%, 99.3%, 99.5%, 99.7%, 99.8%, or 99.9% in blood ANGPTL3 protein level in the subject as compared to prior to the administration as measured by ELISA, Western blots, or LC-MS/MS. In some embodiments, the nucleobase alteration results in a reduction of at most 1%, 2%, 3%, 4%, 5%, 6%, 7%, 8%, 9%, 10%, 15%, 210, 25%, 30%, 31%, 32%, 33%, 34%, 35%, 36%, 37%, 38%, 39%, 40%, 45%, 50%, 55%, 60%, 65%, 70%, 71%, 72%, 73%, 74%, 75%, 76%, 77%, 78%, 79%, 80%, 85%, 90%, 95%, 97%, 98%, 90%, 95%, 97%, 98%, 99%, 99.3%, 99.5%, 99.7%, 99.8%, or 99.9% in blood ANGPTL3 protein level in the subject as compared to prior to the administration as measured by ELISA, Western blots, or LC-MS/MS. In some embodiments, the nucleobase alteration results in a reduction of 1%-99.9%, 2%-99.9%, 3%-99.9%, 4%-99.9%, 5%-99.9%, 6%-99.9%, 7%-99.9%, 8%-99.9%, 9%-99.9%, 10%-99.9%, 15%-99.9%, 20%-99.9%, 25%-99.9%, 30%-99.9%, 31%-99.9%, 32%-99.9%, 33%-99.9%, 34%-99.9%, 35%-99.9%, 36%-99.9%, 37%-99.9%, 38%-99.9%, 39%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% in blood ANGPTL3 protein level in the subject as compared to prior to the administration as measured by ELISA, Western blots, or LC-MS/MS. In some embodiments, the nucleobase alteration results in a reduction of 1%-99.5%, 1%-99%, 1%-98%, 1%-97%, 1%-96%, 1%-95%, 1%-90%, 1%-85%, 1%-80%, 1%-79%, 1%-78%, 1%-77%, 1%-76%, 1%-75%, 1%-74%, 1%-73%, 1%-72%, 1%-71%, 1%-70%, 1%-65%, 1%-60%, 1%-55%, 1%-50%, 1%-45%, 1%-40%, 1%-39%, 1%-38%, 1%-37%, 1%-36%, 1%-35%, 1%-34%, 1%-33%, 1%-32%, 1%-31%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% in blood ANGPTL3 protein level in the subject as compared to prior to the administration as measured by ELISA, Western blots, or LC-MS/MS. In some embodiments, the nucleobase alteration results in a reduction of 1%-99.9%, 5%-99.5%, 10%-99%, 15%-97%, 20%-95%, 25%-90%, 30%-85%, 31%-80%, 32%-79%, 33%-78%, 34%-77%, 35%-76%, 36%-76%, 37%-75%, 38%-74%, 39%-73%, 40%-72%, 45%-71%, 50%-70%, or 55%-65% in blood ANGPTL3 protein level in the subject as compared to prior to the administration as measured by ELISA, Western blots, or LC-MS/MS. In some embodiments, the nucleobase alteration results in a reduction of 100% in blood ANGPTL3 protein level in the subject as compared to prior to the administration as measured by ELISA, Western blots, or LC-MS/MS.

In some embodiments, the nucleobase alteration results in at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, 1000% less blood ANGPTL3 protein level in the subject as compared to prior to the administration as measured by ELISA, Western blots, or LC-MS/MS. In some embodiments, the nucleobase alteration results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less blood ANGPTL3 protein level in the subject as compared to prior to the administration as measured by ELISA, Western blots, or LC-MS/MS.

In some embodiments, the reduction of blood ANGPTL3 protein level or the blood ANGPTL3 protein level in the subject as compared to prior to the administration is measured by ELISA (enzyme-linked immunosorbent assay). In some embodiments, the reduction of blood ANGPTL3 protein level or the blood ANGPTL3 protein level in the subject as compared to prior to the administration is measured by Western blot analysis. In some embodiments, the reduction of blood ANGPTL3 protein level or the blood ANGPTL3 protein level in the subject as compared to prior to the administration is measured by LC-MS/MS (liquid chromatography-tandem mass spectrometry).

In some embodiments, the nucleobase alteration results in a reduction of at least 35% in blood low-density lipoprotein cholesterol (LDL-C) level in the subject as compared to prior to the administration.

In some embodiments, the nucleobase alteration results in a reduction of at least 30%, 35%, 40%, 45%, 46%, 47%, 48%, 49%, 50%, 51%, 52%, 53%, 54%, 55%, 56%, 57%, 58%, 59%, 60%, 61%, 62%, 63%, 64%, 65%, 70%, 75%, 80%, 85%, 90%, 95%, 97%, 98%, or 99% in blood low-density lipoprotein cholesterol (LDL-C) level in the subject as compared to prior to the administration. In some embodiments, the nucleobase alteration results in a reduction of at least 1%, 2%, 3%, 4%, 5%, 6%, 7%, 8%, 9%, 10%, 15%, 20%, 25%, 30%, 35%, 40%, 45%, 46%, 47%, 48%, 49%, 50%, 51%, 52%, 53%, 54%, 55%, 56%, 57%, 58%, 59%, 60%, 61%, 62%, 63%, 64%, 65%, 70%, 75%, 80%, 85%, 90%, 95%, 97%, 98%, 99%, 99.3%, 99.5%, 99.7%, 99.8%, or 99.9% in blood low-density lipoprotein cholesterol (LDL-C) level in the subject as compared to prior to the administration. In some embodiments, the nucleobase alteration results in a reduction of at most 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% in blood low-density lipoprotein cholesterol (LDL-C) level in the subject as compared to prior to the administration. In some embodiments, the nucleobase alteration results in a reduction of 1%-99.9%, 2%-99.9%, 3%-99.9%, 4%-99.9%, 5%-99.9%, 6%-99.9%, 7%-99.9%, 8%-99.9%, 9%-99.9%, 10%-99.9%, 15%-99.9%, 20%-99.9%, 25%-99.9%, 30%-99.9%, 35%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% in blood low-density lipoprotein cholesterol (LDL-C) level in the subject as compared to prior to the administration. In some embodiments, the nucleobase alteration results in a reduction of 1%-99.5%, 1%-99%, 1%-98%, 1%-97%, 1%-96%, 1%-95%, 1%-90%, 1%-85%, 1%-80%, 1%-75%, 1%-70%, 1%-65%, 1%-60%, 1%-55%, 1%-50%, 1%-45%, 1%-40%, 1%-35%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% in blood low-density lipoprotein cholesterol (LDL-C) level in the subject as compared to prior to the administration. In some embodiments, the nucleobase alteration results in a reduction of 1%-99.9%, 5%-99.5%, 10%-99%, 15%-97%, 20%-95%, 25%-90%, 30%-85%, 35%-80%, 40%-75%, 45%-70%, 50%-65%, or 55%-60% in blood low-density lipoprotein cholesterol (LDL-C) level in the subject as compared to prior to the administration. In some embodiments, the nucleobase alteration results in a reduction of 100% in blood low-density lipoprotein cholesterol (LDL-C) level in the subject as compared to prior to the administration. In some embodiments, the nucleobase alteration results in at least 1%, 2%, 3%, 4%, 5%, 6%, 7%, 8%, 9%, 10%, 11%, 12%, 13%, 14%, 1%, 210%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, 1000% less blood low-density lipoprotein cholesterol (LDL-C) level in the subject as compared to prior to the administration. In some embodiments, the nucleobase alteration results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less blood low-density lipoprotein cholesterol (LDL-C) level in the subject as compared to prior to the administration.

In some embodiments, the nucleobase alteration results in a reduction of at least 35% in blood triglyceride level in the subject as compared to prior to the administration.

In some embodiments, the nucleobase alteration results in a reduction of at least 30%, 35%, 40%, 45%, 46%, 47%, 48%, 49%, 50%, 51%, 52%, 53%, 54%, 55%, 56%, 57%, 58%, 59%, 60%, 61%, 62%, 63%, 64%, 65%, 70%, 75%, 80%, 85%, 90%, 95%, 97%, 98%, or 99% in blood triglyceride level in the subject as compared to prior to the administration. In some embodiments, the nucleobase alteration results in a reduction of at least 1%, 2%, 3%, 4%, 5%, 6%, 7%, 8%, 9%, 10%, 15%, 20%, 25%, 30%, 35%, 40%, 45%, 46%, 47%, 48%, 49%, 50%, 51%, 52%, 53%, 54%, 55%, 56%, 57%, 58%, 59%, 60%, 61%, 62%, 63%, 64%, 65%, 70%, 75%, 80%, 85%, 90%, 95%, 97%, 98%, 99%, 99.3%, 99.5%, 99.7%, 99.8%, or 99.9% in blood triglyceride level in the subject as compared to prior to the administration. In some embodiments, the nucleobase alteration results in a reduction of at most 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, 98%, 99%, 99.3%, 99.5%, 99.7%, 99.8%, or 99.9% in blood triglyceride level in the subject as compared to prior to the administration. In some embodiments, the nucleobase alteration results in a reduction of 1%-99.9%, 2%-990.9%, 3%-99.9%, 4%-99.9%, 5%-99.9%, 6%-99.9%, 7%-99.9%, 8%-99.9%, 9%-99.9%, 10%-99.9%, 15%-99.9%, 20%-99.9%, 25%-99.9%, 30%-99.9%, 35%-99.9%, 40%-99.9%, 45%-99.9%, 50%-99.9%, 55%-99.9%, 60%-99.9%, 65%-99.9%, 70%-99.9%, 75%-99.9%, 80%-99.9%, 85%-99.9%, 90%-99.9%, or 95-99.9% in blood triglyceride level in the subject as compared to prior to the administration. In some embodiments, the nucleobase alteration results in a reduction of 1%-99.5%, 1%-99%, 1%-98%, 1%-97%, 1%-96%, 1%-95%, 1%-90%, 1%-85%, 1%-80%, 1%-75%, 1%-70%, 1%-65%, 1%-60%, 1%-55%, 1%-50%, 1%-45%, 1%-40%, 1%-35%, 1%-30%, 1%-25%, 1%-20%, 1%-15%, 1%-10%, 1%-9%, 1%-8%, 1%-7%, 1%-6%, 1%-5%, 1%-4%, 1%-3%, or 1%-2% in blood triglyceride level in the subject as compared to prior to the administration. In some embodiments, the nucleobase alteration results in a reduction of 1%-990.9%, 5%-99.5%, 10%-99%, 15%-97%, 20%-95%, 25%-90%, 30%-85%, 35%-80%, 40%-75%, 45%-70%, 50%-65%, or 55%-60% in blood triglyceride level in the subject as compared to prior to the administration. In some embodiments, the nucleobase alteration results in a reduction of 100% in blood triglyceride level in the subject as compared to prior to the administration. In some embodiments, the nucleobase alteration results in at least 1%, 2%, 3%, 4%, 5%, 6%, 7%, 8%, 9%, 10%, 11%, 12%, 13%, 14%, 15%, 20%, 25%, 30%, 35%, 40%, 50%, 75%, 90%, 100%, 110%, 120%, 130%, 140%, 150%, 160%, 170%, 180%, 190%, 200%, 210%, 220%, 230%, 240%, 250%, 260%, 270%, 280%, 290%, 300%, 400% 500%, 600%, 700%, 800%, 900%, 1000% less blood triglyceride level in the subject as compared to prior to the administration. In some embodiments, the nucleobase alteration results in at least 1.1-fold, 1.2-fold, 1.3-fold, 1.4-fold, 1.5-fold, 1.6-fold, 1.7-fold, 1.8-fold, 1.9-fold, 2-fold, 2.5-fold, 3-fold, 3.5-fold, 4-fold, 4.5-fold, 5-fold, 6-fold, 7-fold, 8-fold, 9-fold, 10-fold, or more than 10-fold less blood triglyceride level in the subject as compared to prior to the administration.

In some embodiments, the blood triglyceride level or the reduction of blood triglyceride level in the subject as compared to prior to the administration is measured by any standard technique. In some embodiments, the blood low-density lipoprotein cholesterol (LDL-C) level or the reduction of blood low-density lipoprotein cholesterol (LDL-C) level in the subject as compared to prior to the administration is measured by any standard technique. For example, a clinical analyzer instrument may be used to measure a 'lipid panel' in serum samples which entails the direct measurement of cholesterol (total C), triglycerides (TG) and high-density lipoprotein cholesterol (HDL-C) enzymatically. Reagent kits specific for each analyte contain buffers, calibrators, blanks and controls. As used in the present disclosure, cholesterol, triglycerides and HDL-C may be quantified using absorbance measurements of specific enzymatic reaction products. LDL-C may be determined indirectly. In some instances, most of circulating cholesterol can be found in three major lipoprotein fractions: very low-density lipoproteins (VLDL), LDL and HDL. In some embodiments, total circulating cholesterol may be estimated with the formula [Total C]=[VLDL-C]+[LDL-C]+[HDL-C]. Thus the LDL-C can be calculated from measured values of total cholesterol, triglycerides and HDL-C according to the relationship: [LDL-C]=[total C]− [HDL-C]-[TG]/5, where [TG]/5 is an estimate of VLDL-cholesterol. A reagent kit specific for triglycerides containing buffers, calibrators, blanks and controls. As used herein, serum samples from the study may be analyzed and triglycerides may be measured using a series of coupled enzymatic reactions. In some embodiments, $H_2O_2$ may be used to quantify the analyte. As the end product of the last one and its absorbance at 500 nm, and the color intensity is proportional to triglyceride concentrations.

In some embodiments, the guide polynucleotide is a guide RNA. In some embodiments, the guide RNA comprises a spacer sequence that binds to the complementary strand of a protospacer sequence of the ANGPTL3 gene with 0, 1, or 2 mismatches. In some embodiments, the guide RNA comprises a spacer sequence that binds to the complementary strand of a protospacer sequence of the ANGPTL3 gene with no mismatches. In some embodiments, the guide RNA comprises a spacer sequence that binds to the complementary strand of a protospacer sequence of the ANGPTL3 gene with 1 mismatch. In some embodiments, the guide RNA comprises a spacer sequence that binds to the complementary strand of a protospacer sequence of the ANGPTL3 gene with 2 mismatches. In some embodiments, the guide RNA comprises a spacer sequence that binds to the complementary strand of a protospacer sequence of the ANGPTL3 gene with 3 mismatches. In some embodiments, the guide RNA comprises a spacer sequence that binds to the complementary strand of a protospacer sequence of the ANGPTL3 gene with 4 mismatches. In some embodiments, the guide RNA comprises a spacer sequence that binds to the complementary strand of a protospacer sequence of the ANGPTL3 gene with 5 mismatches.

In some embodiments, the guide polynucleotide is a guide RNA. In some embodiments, the guide RNA comprises a spacer sequence that binds to the complementary strand of a protospacer sequence of the PCSK9 gene with 0, 1, or 2 mismatches. In some embodiments, the guide RNA comprises a spacer sequence that binds to the complementary strand of a protospacer sequence of the PCSK9 gene with no mismatches. In some embodiments, the guide RNA comprises a spacer sequence that binds to the complementary strand of a protospacer sequence of the PCSK9 gene with 1 mismatch. In some embodiments, the guide RNA comprises a spacer sequence that binds to the complementary strand of a protospacer sequence of the PCSK9 gene with 2 mismatches. In some embodiments, the guide RNA comprises a spacer sequence that binds to the complementary strand of a protospacer sequence of the PCSK9 gene with 3 mismatches. In some embodiments, the guide RNA comprises a spacer sequence that binds to the complementary strand of a protospacer sequence of the PCSK9 gene with 4 mismatches. In some embodiments, the guide RNA comprises a spacer sequence that binds to the complementary strand of a protospacer sequence of the PCSK9 gene with 5 mismatches.

In some embodiments, the nucleobase alteration is outside of the protospacer sequence in less than 1% of whole liver cells in the subject as measured by net nucleobase editing. In some embodiments, the nucleobase alteration is outside of the protospacer sequence in less than 1% of hepatocytes in the subject as measured by net nucleobase editing.

In some embodiments, the nucleobase alteration is only within the protospacer sequence as measured by net nucleobase editing.

In some embodiments, the nucleobase alteration is outside of the protospacer sequence in less than 0.01%. 0.02%, 0.03% 0.04%, 0.05%, 0.06%, 0.07%, 0.08%, 0.09%, 0.1%, 0.2%, 0.3%, 0.4%, 0.5%, 0.6%, 0.7%, 0.8%, 0.9%0, 1.0%, 2.0%, 3.0% 4.0%, 5.0%, 6.0%, 7.0%, 8.0%, 9.0%0, 10%, 15%, 20%, 25%, 30%, 35%, 40%, 45%, 50%, 55%, 60%, 65%, 70%, 65%, 80%, 85%, 90% of whole liver cells in the subject as measured by net nucleobase editing. In some embodiments, the nucleobase alteration is outside of the protospacer sequence in less than 0.01%. 0.02%, 0.03% 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1.0%, 2.0%, 3.0% 4.0%, 5.0%, 6.0%, 7.0%, 8.0%, 9.0%0, 10%, 15%, 20%, 25%, 30%, 35%, 40%, 45%, 50%, 55%, 60%, 65%, 70%, 65%, 80%, 85%, 90% of hepatocytes in the subject as measured by net nucleobase editing. In some embodiments, the nucleobase alteration is outside of the protospacer sequence in less than 0.01%. 0.02%, 0.03% 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1.0%, 2.0%, 3.0% 4.0%, 5.0%, 6.0%, 7.0%, 8.0%, 9.0%0, 10%, 15%, 20%, 25%, 30%, 35%, 40%, 45%, 50%, 55%, 60%, 65%, 70%, 65%, 80%, 85%, 90% of cells in the subject as measured by net nucleobase editing.

In some embodiments, the administration is via intravenous infusion. In some embodiments, the method for treating or preventing a condition in a subject in need thereof as described herein comprises sequential administration of the LNP enclosing (i) a guide polynucleotide or a nucleic acid encoding the guide polynucleotide and the second LNP enclosing (ii) a base editor fusion protein comprising a programmable DNA binding domain and a deaminase, or a nucleic acid encoding same. In some embodiments, the method for treating or preventing a condition in a subject in need thereof as described herein comprises concurrent administration of the LNP enclosing (i) a guide polynucleotide or a nucleic acid encoding the guide polynucleotide and the second LNP enclosing (ii) a base editor fusion protein comprising a programmable DNA binding domain and a deaminase, or a nucleic acid encoding same. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same followed by staggered doses of the LNP enclosing (i) a guide polynucleotide or a nucleic acid encoding the guide polynucleotide over an interval of 1, 2, 3, 4, 5, 6, or 7 days.

In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same followed by staggered doses of the LNP enclosing (i) a guide polynucleotide or a nucleic acid encoding the guide polynucleotide over an interval of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 hours. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same followed by staggered doses of the LNP enclosing (i) a guide polynucleotide or a nucleic acid encoding the guide polynucleotide over an interval of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 days. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same followed by staggered doses of the LNP enclosing (i) a guide polynucleotide or a nucleic acid encoding the guide polynucleotide over an interval of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, or 36 months.

The method as described herein may be used for treating or preventing a condition in a subject in need thereof. In some embodiments, the method comprises administering a single dose of a LNP enclosing (i) a guide polynucleotide, e.g., a guide RNA, or a nucleic acid encoding the guide polynucleotide and (ii) a base editor fusion protein or a nucleic acid encoding the base editor fusion protein, e.g., an mRNA encoding the base editor fusion protein. For example, the method may comprise administering an LNP enclosing (i) a guide RNA and (i) an mRNA encoding the base editor fusion protein. The LNP may be administered at a single dose or multiple doses. In other embodiments, the method comprises administering a LNP enclosing (i) a guide polynucleotide or a nucleic acid encoding the guide polynucleotide, and a second LNP enclosing (ii) the base editor fusion protein or a nucleic acid encoding the base editor fusion protein. The LNP may be administered at a single dose or multiple doses.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 1 day, and the multiple doses are given at 1 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 1 day, and the multiple doses are given at 2 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 1 day, and the multiple doses are given at 3 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 1 day, and the multiple doses are given at 4 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 1 day, and the multiple doses are given at 5 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 1 day, and the multiple doses are given at 6 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 1 day, and the multiple doses are given at 7 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 2 days, and the multiple doses are given at 1 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 2 days, and the multiple doses are given at 2 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 2 days, and the multiple doses are given at 3 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 2 days, and the multiple doses are given at 4 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 2 days, and the multiple doses are given at 5 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 2 days, and the multiple doses are given at 6 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 2 days, and the multiple doses are given at 7 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 3 days, and the multiple doses are given at 1 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 3 days, and the multiple doses are given at 2 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 3 days, and the multiple doses are given at 3 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 3 days, and the multiple doses are given at 4 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 3 days, and the multiple doses are given at 5 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 3 days, and the multiple doses are given at 6 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 3 days, and the multiple doses are given at 7 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 4 days, and the multiple doses are given at 1 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 4 days, and the multiple doses are given at 2 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 4 days, and the multiple doses are given at 3 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 4 days, and the multiple doses are given at 4 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 4 days, and the multiple doses are given at 5 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 4 days, and the multiple doses are given at 6 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 4 days, and the multiple doses are given at 7 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 5 days, and the multiple doses are given at 1 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 5 days, and the multiple doses are given at 2 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 5 days, and the multiple doses are given at 3 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 5 days, and the multiple doses are given at 4 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 5 days, and the multiple doses are given at 5 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 5 days, and the multiple doses are given at 6 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 5 days, and the multiple doses are given at 7 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 6 days, and the multiple doses are given at 1 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 6 days, and the multiple doses are given at 2 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 6 days, and the multiple doses are given at 3 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 6 days, and the multiple doses are given at 4 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 6 days, and the multiple doses are given at 5 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 6 days, and the multiple doses are given at 6 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 6 days, and the multiple doses are given at 7 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 7 days, and the multiple doses are given at 1 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 7 days, and the multiple doses are given at 2 day intervals.

In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 7 days, and the multiple doses are given at 3 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 7 days, and the multiple doses are given at 4 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 7 days, and the multiple doses are given at 5 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 7 days, and the multiple doses are given at 6 day intervals. In some embodiments, the method for treating or preventing a condition in a subject in need thereof as described herein comprises administering a single dose of the LNP enclosing (i) a guide polynucleotide or a nucleic acid encoding same and administering multiple doses of the LNP enclosing (ii) a base editor fusion protein comprising a programmable DNA binding domain and a deaminase, or a nucleic acid encoding same after 7 days, and the multiple doses are given at 7 day intervals.

In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 1 day, and the multiple doses are given at 1 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 1 day, and the multiple doses are given at 2 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 1 day, and the multiple doses are given at 3 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 1 day, and the multiple doses are given at 4 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 1 day, and the multiple doses are given at 5 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 1 day, and the multiple doses are given at 6 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 1 day, and the multiple doses are given at 7 day intervals.

In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 2 days, and the multiple doses are given at 1 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 2 days, and the multiple doses are given at 2 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 2 days, and the multiple doses are given at 3 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 2 days, and the multiple doses are given at 4 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 2 days, and the multiple doses are given at 5 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 2 days, and the multiple doses are given at 6 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 2 days, and the multiple doses are given at 7 day intervals.

In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 3 days, and the multiple doses are given at 1 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 3 days, and the multiple doses are given at 2 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 3 days, and the multiple doses are given at 3 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 3 days, and the multiple doses are given at 4 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 3 days, and the multiple doses are given at 5 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 3 days, and the multiple doses are given at 6 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 3 days, and the multiple doses are given at 7 day intervals.

In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 4 days, and the multiple doses are given at 1 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 4 days, and the multiple doses are given at 2 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 4 days, and the multiple doses are given at 3 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 4 days, and the multiple doses are given at 4 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 4 days, and the multiple doses are given at 5 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 4 days, and the multiple doses are given at 6 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 4 days, and the multiple doses are given at 7 day intervals.

In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 5 days, and the multiple doses are given at 1 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 5 days, and the multiple doses are given at 2 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 5 days, and the multiple doses are given at 3 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 5 days, and the multiple doses are given at 4 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 5 days, and the multiple doses are given at 5 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 5 days, and the multiple doses are given at 6 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 5 days, and the multiple doses are given at 7 day intervals.

In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 6 days, and the multiple doses are given at 1 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 6 days, and the multiple doses are given at 2 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 6 days, and the multiple doses are given at 3 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 6 days, and the multiple doses are given at 4 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 6 days, and the multiple doses are given at 5 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 6 days, and the multiple doses are given at 6 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 6 days, and the multiple doses are given at 7 day intervals.

In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 7 days, and the multiple doses are given at 1 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 7 days, and the multiple doses are given at 2 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 7 days, and the multiple doses are given at 3 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 7 days, and the multiple doses are given at 4 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 7 days, and the multiple doses are given at 5 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 7 days, and the multiple doses are given at 6 day intervals. In some embodiments, the method for treating or preventing a condition in a subject in need thereof as described herein comprises administering a single dose of the LNP enclosing (ii) a base editor fusion protein comprising a programmable DNA binding domain and a deaminase, or a nucleic acid encoding same and administering multiple doses of the LNP enclosing (i) a guide polynucleotide or a nucleic acid encoding same after 7 days, and the multiple doses are given at 7 day intervals.

In some embodiments, the method for treating or preventing a condition in a subject in need thereof as described herein comprises administering a single dose of the LNP enclosing (i) a guide polynucleotide or a nucleic acid encoding the guide polynucleotide and (ii) a base editor fusion protein comprising a programmable DNA binding domain and a deaminase, or a nucleic acid encoding same. In some embodiments, the single dose of the LNP is at 0.3 mg/kg. In some embodiments, the single dose of the LNP is at 0.5 mg/kg. In some embodiments, the single dose of the LNP is at 1 mg/kg. In some embodiments, the single dose of the LNP is at 1 mg/kg. In some embodiments, the single dose of the LNP is at about 0.3 to about 3 mg/kg.

Methods for treatment of a condition as provided herein may comprise a treatment course of one or more treatments, with each treatment comprising a single dose or multiple doses of a base editor system, or a LNP enclosing one or more components of the base editor system. For example, a subject in need thereof may be administered a single dose of a LNP enclosing a mRNA encoding a base editor fusion protein and a guide RNA for a treatment. In some embodiments, a subject may be administered a treatment course of one or more treatments, wherein each treatment comprises one or more of the single doses of the LNP, for example, a subject may also be administered 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more doses of a LNP enclosing a mRNA encoding a base editor fusion protein and a guide RNA for a treatment. The subject may receive a treatment course of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more treatments, where each dose may be administered 1 day, 2 days, 3 days, 4 days, 5 days, 6 days, 1 week, 2 weeks, 3 weeks, 1 month, 2 months, 3 months, 6 months, 9 months, 12 months, 24 months, 48 months or apart. A single dose for the treatment as described herein may comprise a LNP enclosing a guide RNA or a mRNA encoding the base editor fusion protein, or both.

In some embodiments, the single dose of the LNP comprises 0.1 mg/kg, 0.2 mg/kg, 0.3 mg/kg, 0.4 mg/kg, 0.5 mg/kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.1 mg/kg, 2.2 mg/kg, 2.3 mg/kg, 2.4 mg/kg, 2.5 mg/kg, 2.6 mg/kg, 2.7 mg/kg, 2.8 mg/kg, 2.9 mg/kg, 3.0 mg/kg, 3.1 mg/kg, 3.2 mg/kg, 3.3 mg/kg, 3.4 mg/kg, 3.5 mg/kg, 3.6 mg/kg, 3.7 mg/kg, 3.8 mg/kg, 3.9 mg/kg, 4.0 mg/kg, 4.1 mg/kg, 4.2 mg/kg, 4.3 mg/kg, 4.4 mg/kg, 4.5 mg/kg, 4.6 mg/kg, 4.7 mg/kg, 4.8 mg/kg, 4.9 mg/kg, 5.0 mg/kg, 5.1 mg/kg, 5.2 mg/kg, 5.3 mg/kg, 5.4 mg/kg, 5.5 mg/kg, 5.6 mg/kg, 5.7 mg/kg, 5.8 mg/kg, 5.9 mg/kg, 6.0 mg/kg, 6.1 mg/kg, 6.2 mg/kg, 6.3 mg/kg, 6.4 mg/kg, 6.5 mg/kg, 6.6 mg/kg, 6.7 mg/kg, 6.8 mg/kg, 6.9 mg/kg, 7.0 mg/kg, 7.1 mg/kg, 7.2 mg/kg, 7.3 mg/kg, 7.4 mg/kg, 7.5 mg/kg, 7.6 mg/kg, 7.7 mg/kg, 7.8 mg/kg, 7.9 mg/kg, 8.0 mg/kg, 8.1 mg/kg, 8.2 mg/kg, 8.3 mg/kg, 8.4 mg/kg, 8.5 mg/kg, 8.6 mg/kg, 8.7 mg/kg, 8.8 mg/kg, 8.9 mg/kg, 9.0 mg/kg, 9.1 mg/kg, 9.2 mg/kg, 9.3 mg/kg, 9.4 mg/kg, 9.5 mg/kg, 9.6 mg/kg, 9.7 mg/kg, 9.8 mg/kg, 9.9 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 25 mg/kg, 30 mg/kg, 35 mg/kg, 40 mg/kg, 45 mg/kg, 50 mg/kg, 55 mg/kg, 60 mg/kg, 65 mg/kg, 70 mg/kg, 75 mg/kg, 80 mg/kg, 85 mg/kg, 90 mg/kg, 95 mg/kg, 100 mg/kg, 105 mg/kg, 110 mg/kg, 115 mg/kg, 120 mg/kg, 125 mg/kg, 130 mg/kg, 135 mg/kg, 140 mg/kg, 145 mg/kg, 150 mg/kg, 155 mg/kg, 160 mg/kg, 165 mg/kg, 170 mg/kg, 175 mg/kg, 180 mg/kg, 185 mg/kg, 190 mg/kg, 195 mg/kg, 200 mg/kg, 250 mg/kg, 300 mg/kg, 350 mg/kg, 400 mg/kg, 450 mg/kg, or 500 mg/kg.

In some embodiments, the condition is a atherosclerotic cardiovascular disease. In some embodiments, the condition is a cardiovascular disease, or diabetes. In some embodiments, the condition is a atherosclerotic vascular disease.

In some embodiments, the subject is a non-human primate. In some embodiments, the subject is a monkey. In some embodiments, the subject is a human. In some embodiments, the deaminase is an adenine deaminase. In some embodiments, the nucleobase alteration is a A·T to G·C alteration. In some embodiments, the deaminase is an adenine deaminase and the nucleobase alteration is a A·T to G·C alteration. In some embodiments, the programmable DNA binding domain comprises a nuclease inactive Cas9. In some embodiments, the programmable DNA binding domain comprises a Cas9 nickase. In some embodiments, the programmable DNA binding domain comprises a Cas9.

In some embodiments, the nucleobase alteration is at a splice site of the PCSK9 gene. In some embodiments, the nucleobase alteration is at a splice donor site of the PCSK9 gene. In some embodiments, the splice donor site is at 5' end of PCSK9 intron 1 as referenced in SEQ ID NO: 5. In some embodiments, the nucleobase alteration is at a splice acceptor site of the PCSK9 gene. In some embodiments, the nucleobase alteration results in a frame shift, a premature stop codon, a insertion or deletion in a transcript encoded by the PCSK9 gene. In some embodiments, the nucleobase alteration results in an aberrant transcript encoded by the PCSK9 gene. In some embodiments, the guide polynucleotide is a guide RNA. In some embodiments, the guide RNA is chemically modified. In some embodiments, the guide RNA comprises a tracrRNA sequence. In some embodiments, the guide RNA comprises a chemical modification as set forth in Table 1 or Table 24.

In some embodiments, the nucleobase alteration is at a splice site of the ANGPTL3 gene. In some embodiments, the nucleobase alteration is at a splice donor site of the ANGPTL3 gene. In some embodiments, the splice donor site is at 5' end of ANGPTL3 intron 6 as referenced in SEQ ID NO: 7. In some embodiments, the nucleobase alteration is at a splice acceptor site of the ANGPTL3 gene. In some embodiments, the nucleobase alteration results in a frame shift, a premature stop codon, a insertion or deletion in a transcript encoded by the ANGPTL3 gene. In some embodiments, the nucleobase alteration results in an aberrant transcript encoded by the ANGPTL3 gene. In some embodiments, the guide polynucleotide is a guide RNA. In some embodiments, the guide RNA is chemically modified. In some embodiments, the guide RNA comprises a tracrRNA sequence. In some embodiments, the guide RNA comprises a chemical modification as set forth in Table 1 or Table 24.

In some embodiments, the guide RNA comprises a guide RNA sequence set forth in Table 1 or Table 24. In some embodiments, the guide RNA comprises the sequence

```
                                      (SEQ ID NO: 9)
5'-5'-
cscscsGCACCUUGGCGCAGCGGgUUUUAGagcuaGaaauagcaaGUUa
AaAuAaggCUaGUCcG UUAucAAcuuGaaaaguGgcaccgAgUCggu
gcusususu-3', (SEQ ID NO: 9)
5'-cscscsGCACCUUGGCGCAGCGGgUUUUAGagcuagaaauagcaaG
UUaAaAuAaggcuaGUccGU UAucAAcuugaaaaagugGcaccgaguc
ggugcusususu-3', (SEQ ID NO: 9)
5'-cscscsGCACCUUGGCGCAGCGGgUUUUAGagcuaGaaauagcaaG
UUaAaAuAaggcuaGUccGUUAucAAcuuGaaaaagugGcaccgagucg
gugcusususu-3' (GA346), (SEQ ID NO: 65)
5'-cscscsGCACCUUGGCGCAGCGGgUUUUAGagcuagaaauagcaaG
UUaAaAuAaggcuaGUccGUUAacAAcuugaaaaagugGcaccgagucg
gugcusususu-3 (GA374), (SEQ ID NO: 11)
5'-cscscsGCACCUUGGCGCAGCGGgUUUUAGagcuagaaauagcaaG
UUaAaAuAaggcuaGUccGUUAucAAcuugaaaaagugGcaccgagucg
gugcusususuuuu-3' (GA385), (SEQ ID NO: 11)
5'-cscscsGCACCUUGGCGCAGCGGgUUUUAGagcuagaaauagcaaG
UUaAaAuAaggcuaGUccGUUAucAAcuugaaaaagugGcaccgagucg
gugcusususuuUu-3' (GA386) or (SEQ ID NO: 12)
5'-
cscscsGCACCUUGGCGCAGCGgUUUUAGagcuaGaaauagcaaGUUaA
aAuAaggcuaGUccGUUAucAAcuuGaaaaagugGcaccgagucggugc
uususuuuu-3' (GA387).
```

In some embodiments, the protospacer sequence comprises a protospacer sequence set forth in Table 1 or Table 24. In some embodiments, the protospacer comprises the sequence

```
                                     (SEQ ID NO: 13)
             5'-CCCGCACCTTGGCGCAGCGG-3', (SEQ ID NO: 14)
             AAGATACCTGAATAACTCTC-3' or (SEQ ID NO: 15)
             5'-AAGATACCTGAATAACCCTC-3'.
```

In some embodiments, the base editor fusion protein comprises the sequence of SEQ ID NO: 3. In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the amino acid sequence set forth in SEQ ID NO: 3 or to any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to the amino acid sequence set forth in SEQ ID NO: 3 or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NO: 3 or any of the adenosine deaminases provided herein.

In some embodiments, the mRNA comprises a cap analog.

In some embodiments, the mRNA comprises at least 1, 2, or 3 nucleotides at the 5' end that comprises 2'-hydroxyl group, 2'-O-methyl group, or additional 2' chemical modification or a combination thereof. In some embodiments, the mRNA comprises at least 1, 2, or 3 nucleotides at the 5' end that comprises 2'-hydroxyl group, 2'-O-methyl group, or additional 2' chemical modification or a combination thereof. In some embodiments, the mRNA comprises at least 1 nucleotide at the 5' end that comprises 2'-hydroxyl group, 2'-O-methyl group, or additional 2' chemical modification or a combination thereof. In some embodiments, the mRNA comprises at least 2 nucleotides at the 5' end that comprises 2'-hydroxyl group, 2'-O-methyl group, or additional 2' chemical modification or a combination thereof. In some embodiments, the mRNA comprises at least 3 nucleotides at the 5' end that comprises 2'-hydroxyl group, 2'-O-methyl group, or additional 2' chemical modification or a combination thereof. In some embodiments, the mRNA comprises at least 4 nucleotides at the 5' end that comprises 2'-hydroxyl group, 2'-O-methyl group, or additional 2' chemical modification or a combination thereof. In some embodiments, the mRNA comprises at least 5 nucleotides at the 5' end that comprises 2'-hydroxyl group, 2'-O-methyl group, or additional 2' chemical modification or a combination thereof. In some embodiments, the mRNA comprises at least 6 nucleotides at the 5' end that comprises 2'-hydroxyl group, 2'-O-methyl group, or additional 2' chemical modification or a combination thereof. In some embodiments, the mRNA comprises at least 7 nucleotides at the 5' end that comprises 2'-hydroxyl group, 2'-O-methyl group, or additional 2' chemical modification or a combination thereof. In some embodiments, the mRNA comprises at least 8 nucleotides at the 5' end that comprises 2'-hydroxyl group, 2'-O-methyl group, or additional 2' chemical modification or a combination thereof. In some embodiments, the mRNA comprises at least 9 nucleotides at the 5' end that comprises 2'-hydroxyl group, 2'-O-methyl group, or additional 2' chemical modification or a combination thereof. In some embodiments, the mRNA comprises at least 10 nucleotides at the 5' end that comprises 2'-hydroxyl group, 2'-O-methyl group, or additional 2' chemical modification or a combination thereof.

In some embodiments, the mRNA comprises a poly A tail.

The compositions described herein, may be administered to a subject in need thereof, in a therapeutically effective amount, to treat conditions related to high circulating cholesterol levels. Conditions related to high circulating cholesterol level that may be treated using the compositions and methods described herein include, without limitation: hypercholesterolemia, elevated total cholesterol levels, elevated low-density lipoprotein (LDL) levels, elevated blood LDL-cholesterol levels, reduced blood high-density lipoprotein cholesterol level, liver steatosis, coronary heart disease, vascular disease, ischemia, stroke, peripheral vascular disease, thrombosis, type 2 diabetes, hypertriglyceridemia, high elevated blood pressure, atherosclerosis, obesity, Alzheimer's disease, neurodegeneration, and combinations thereof. The compositions and methods disclosed herein are effective in reducing the circulating cholesterol level in the subject, thus treating the conditions. The compositions and methods disclosed herein are effective in reducing blood LDL cholesterol level and/or a reducing blood triglycerides level as compared to before the administration.

In another aspect, provided herein is a method for treating or preventing a condition in a subject in need thereof, the method comprising administering to the subject the complex as provided herein, the composition as provided herein, or the lipid nanoparticle as provided herein, wherein the sgRNA directs the adenosine base editor protein to effect a modification in a target polynucleotide sequence in a cell of the subject, thereby treating or preventing the condition.

In some embodiments, the target polynucleotide sequence is in a PCSK9 gene. In some embodiments, the modification reduces expression of functional PCSK9 protein encoded by the PCSK9 gene in the subject. In some embodiments, the condition is atherosclerotic vascular disease. In some embodiments, the target polynucleotide sequence is in an ANGPTL3 gene. In some embodiments, the modification reduces expression of functional ANGPTL3 protein encoded by the ANGPTL3 gene in the subject. In some embodiments, the condition is an atherosclerotic vascular disease, hypertriglyceridemia, or diabetes.

A patient who is being treated for a condition, a disease or a disorder is one who a medical practitioner has diagnosed as having such a condition. Diagnosis may be by any suitable means. Diagnosis and monitoring may involve, for example, detecting the presence of diseased, dying or dead cells in a biological sample (e.g., tissue biopsy, blood test, or urine test), detecting the presence of plaques, detecting the level of a surrogate marker in a biological sample, or detecting symptoms associated with a condition. A patient in whom the development of a condition is being prevented may or may not have received such a diagnosis. One in the art will understand that these patients may have been subjected to the same standard tests as described above or may have been identified, without examination, as one at high risk due to the presence of one or more risk factors (e.g., family history or genetic predisposition).

The therapeutic methods of the disclosure may be carried out on subjects displaying pathology resulting from a disease or a condition, subjects suspected of displaying pathology resulting from a disease or a condition, and subjects at risk of displaying pathology resulting from a disease or a condition. For example, subjects that have a genetic predisposition to a disease or a condition can be treated prophylactically. Subjects exhibiting symptoms associated with a condition, a disease or a disorder may be treated to decrease the symptoms or to slow down or prevent further progression of the symptoms. The physical changes associated with the increasing severity of a disease or a condition are shown herein to be progressive. Thus, in embodiments of the disclosure, subjects exhibiting mild signs of the pathology associated with a condition or a disease may be treated to improve the symptoms and/or prevent further progression of the symptoms.

In some embodiments, the subject exhibits a reduced blood LDL cholesterol level and/or a reduced blood triglycerides level as compared to before the administration.

In some embodiments, after the administration, the subject exhibits a reduced blood low-density lipoprotein (LDL) cholesterol level by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 97%, at least 98%, at least 99%, at least 99.5%, at least 99.9%, or 100% as compared to before the administration. In some embodiments, after the administration, the subject exhibits a reduced blood low-density lipoprotein (LDL) cholesterol level by at least 2 fold, at least 3 fold, at least 4 fold, at least 5 fold, at least 10 fold, at least 20 fold, at least 25 fold, at least 30 fold, at least 40 fold, at least 50 fold, at least 60 fold, at least 70 fold, at least 80 fold, at least 90 fold, at least 100 fold, at least 200 fold, at least 300 fold, at least 400 fold, at least 500 fold, at least 600 fold, at least 700 fold, at least 800 fold, at least 900 fold, at least 1000 fold, at least 2000 fold, at least 3000 fold, at least 4000 fold, at least 5000 fold, at least 6000 fold, at least 7000 fold, at least 8000 fold, at least 9000 fold, or at least 10000 fold as compared to before the administration.

In some embodiments, after the administration, the subject exhibits a reduced blood triglycerides level by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 97%, at least 98%, at least 99%, at least 99.5%, at least 99.9%, or 100% as compared to before the administration.

In some embodiments, after the administration, the subject exhibits a reduced blood triglycerides level by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 97%, at least 98%, at least 99%, at least 99.5%, at least 99.9%, or 100% as compared to before the administration. In some embodiments, after the administration, the subject exhibits a reduced blood triglycerides level by at least 2 fold, at least 3 fold, at least 4 fold, at least 5 fold, at least 10 fold, at least 20 fold, at least 25 fold, at least 30 fold, at least 40 fold, at least 50 fold, at least 60 fold, at least 70 fold, at least 80 fold, at least 90 fold, at least 100 fold, at least 200 fold, at least 300 fold, at least 400 fold, at least 500 fold, at least 600 fold, at least 700 fold, at least 800 fold, at least 900 fold, at least 1000 fold, at least 2000 fold, at least 3000 fold, at least 4000 fold, at least 5000 fold, at least 6000 fold, at least 7000 fold, at least 8000 fold, at least 9000 fold, or at least 10000 fold as compared to before the administration.

The dosage and frequency (single or multiple doses) administered to a mammal can vary depending upon a variety of factors, for example, whether the mammal suffers from another disease, and its route of administration; size, age, sex, health, body weight, body mass index, and diet of the recipient; nature and extent of symptoms of the disease being treated, kind of concurrent treatment, complications from the disease being treated or other health-related problems. Adjustment and manipulation of established dosages (e.g., frequency and duration) are well within the ability of those skilled in the art. The treatment, such as those disclosed herein, can be administered to the subject on a daily, twice daily, biweekly, monthly or any applicable basis that is therapeutically effective. In embodiments, the treatment is only on an as-needed basis, e.g., upon appearance of signs or symptoms of a condition or a disease, e.g., an atherosclerotic vascular disease, hypertriglyceridemia, or diabetes.

The compositions described herein, may be administered to a subject in need thereof, in a therapeutically effective amount, to treat conditions related to high circulating cholesterol levels. Conditions related to high circulating cholesterol level that may be treated using the compositions and methods described herein include, without limitation: hypercholesterolemia, elevated total cholesterol levels, elevated low-density lipoprotein (LDL) levels, elevated blood LDL-cholesterol levels, reduced blood high-density lipoprotein cholesterol level, liver steatosis, coronary heart disease, vascular disease, ischemia, stroke, peripheral vascular disease, thrombosis, type 2 diabetes, hypertriglyceridemia, high elevated blood pressure, atherosclerosis, obesity, Alzheimer's disease, neurodegeneration, and combinations thereof. The compositions and methods disclosed herein are effective in reducing the circulating cholesterol level in the subject, thus treating the conditions. The compositions and methods disclosed herein are effective in reducing blood LDL cholesterol level and/or a reducing blood triglycerides level as compared to before the administration.

Toxicity and therapeutic efficacy of the compositions of the disclosure can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects (the ratio LD50/ED50) is the therapeutic index. Agents that exhibit high therapeutic indices are preferred. The dosage of agents lies preferably within a range of circulating concentrations that include the ED50 with little or no toxicity. While agents that exhibit toxic side effects may be used, care should be taken to design a delivery system that targets such agents to the site of affected tissue in order to minimize potential damage to uninfected cells and, thereby, reduce side effects.

The skilled artisan will appreciate that certain factors may influence the dosage and frequency of administration required to effectively treat a subject, including but not limited to the severity of the disease or disorder, previous treatments, the general characteristics of the subject including health, sex, weight and/or age of the subject, and other diseases present. Moreover, treatment of a subject with a therapeutically effective amount of the compositions can include a single treatment or, preferably, can include a series of treatments. It will also be appreciated that the effective dosage of the composition of the disclosure used for treatment may increase or decrease over the course of a particular treatment. Changes in dosage may result and become apparent from the results of diagnostic assays as described herein. The therapeutically-effective dosage will generally be dependent on the patient's status at the time of administration. The precise amount can be determined by routine experimentation but may ultimately lie with the judgment of the clinician, for example, by monitoring the patient for signs of disease and adjusting the treatment accordingly.

Frequency of administration may be determined and adjusted over the course of therapy, and is generally, but not necessarily, based on treatment and/or suppression and/or amelioration and/or delay of a disease. Alternatively, sustained continuous release formulations of a polypeptide or a polynucleotide may be appropriate. Various formulations and devices for achieving sustained release are known in the art. In some embodiments, dosage is daily, every other day, every three days, every four days, every five days, or every six days. In some embodiments, dosing frequency is once every week, every 2 weeks, every 4 weeks, every 5 weeks, every 6 weeks, every 7 weeks, every 8 weeks, every 9 weeks, or every 10 weeks; or once every month, every 2 months, or every 3 months, or longer. The progress of this therapy is easily monitored by conventional techniques and assays.

The dosing regimen (including a composition disclosed herein) can vary over time. In some embodiments, for an adult subject of normal weight, doses ranging from about 0.01 to 1000 mg/kg may be administered. In some embodiments, the dose is between 1 to 200 mg. The particular dosage regimen, i.e., dose, timing and repetition, will depend on the particular subject and that subject's medical history, as well as the properties of the polypeptide or the polynucleotide (such as the half-life of the polypeptide or the polynucleotide, and other considerations well known in the art).

For the purpose of the present disclosure, the appropriate therapeutic dosage of a composition as described herein will depend on the specific agent (or compositions thereof) employed, the formulation and route of administration, the type and severity of the disease, whether the polypeptide or the polynucleotide is administered for preventive or therapeutic purposes, previous therapy, the subject's clinical history and response to the antagonist, and the discretion of the attending physician. Typically, the clinician will administer a polypeptide until a dosage is reached that achieves the desired result.

Administration of one or more compositions can be continuous or intermittent, depending, for example, upon the recipient's physiological condition, whether the purpose of the administration is therapeutic or prophylactic, and other factors known to skilled practitioners. The administration of a composition may be essentially continuous over a preselected period of time or may be in a series of spaced dose, e.g., either before, during, or after developing a disease.

The methods and compositions of the disclosure described herein including embodiments thereof can be administered with one or more additional therapeutic regimens or agents or treatments, which can be co-administered to the mammal.

Metabolic Syndrome and Cardiovascular Disease

The ability of gene modification, especially to edit bases directly allows for the precise edit, modification, and/or disruption of genes in vivo without the need to create DSBs and improved methods of treating human disease. For example, Chadwick et. al used cytosine base editing to introduce nonsense mutations into the Pcsk9 gene in adult mice. Delivery of BE3 and a gRNA via adenoviral vector into the liver caused a reduction in plasma PCSK9 levels by 56%. Furthermore, cholesterol levels in the base-edited mice were reduced by roughly 30%. In subsequent work, cytosine base editing to disrupt the Angptl3 gene in adult mice resulted in substantially reduced blood cholesterol and triglyceride levels, and cytosine base editing to disrupt the Pcsk9 gene or the Hpd gene in fetal mice resulted in postnatal reduction of cholesterol levels or cure of the disease hereditary tyrosinemia type 1.

Cardiovascular disease, obesity, type 2 diabetes, metabolic syndrome may share one or more similar underlying etiologies. The human PCSK9 gene encodes a protein that helps regulate the amount of cholesterol in the bloodstream. The liver protein Proprotein Convertase Subtilisin/Kexin Type 9 (PCSK9) in human is a secreted, globular, auto-activating serine protease that acts as a protein-binding adaptor within endosomal vesicles to bridge a pH-dependent interaction with the low-density lipoprotein receptor (LDL-R) during endocytosis of LDL particles, preventing recycling of the LDL-R to the cell surface and leading to reduction of LDL-cholesterol clearance. PCSK9 orthologs are found across many species. The PCSK9 protein breaks down low-density lipoprotein receptors before they reach the cell surface, so more cholesterol can remain in the bloodstream. As a result, the PCSK9 gene and the encoded PCSK9 protein are attractive targets for regulating cholesterol metabolism, especially in lowering blood cholesterol levels.

Other targets have also been shown that are associated with decreased plasma levels of triglycerides (TGs), low-density lipoprotein cholesterol (LDL-C), and high-density lipoprotein cholesterol (HDL-C), which leads to a significant reduction in cardiovascular risk. For example, human ANGPTL3 is considered an important new pharmacological target for the treatment of cardiovascular diseases. Experimental evidence demonstrates that anti-ANGPTL3 therapies have an important anti-atherosclerotic effect. Results from phase I clinical trials with a monoclonal anti-ANGPTL3 antibody (evinacumab) and anti-sense oligonucleotide (ASO) clearly show a significant lipid lowering effect.

Human ANGPTL3 gene is located on chromosome 1p31. Genetic variants of human ANGPTL3 gene have been linked to different plasma lipid profiles. For example, homozygous loss of function (LOF) variants of ANGPTL3 gene cause the levels of all plasma lipoproteins to be greatly reduced. ANGPTL3 is exclusively expressed in the liver and is secreted into circulation where it goes through cleavage by hepatic proprotein convertases. The ANGPTL3 protein is a 460-amino-acid (aa) polypeptide with a distinctive signal peptide sequence, a N-terminal helical domain and a C-terminal globular fibrinogen homology domain. The N-terminal coiled-coil region (17-207aa) affects plasma TG levels via reversibly inhibiting catalytic activity of LPL while the fibrinogen-like domain (207-460aa) binds to integrin $\alpha v \beta 3$ receptor and affects angiogenesis, which is similar to the function of angiopoietins. A short linker region (at 221-222 and 224-225) between N- and C-terminal domains is a special zone, which has been verified to be split by furin. Existed results have shown that the truncated form of cleavage ANGPTL3 could reinforce the inhibitory activity of LPL and endothelial lipase (EL), suggesting that the cleavage type of ANGPTL3 may function more effectively.

Moreover, human apolipoprotein C-III (APOC3) could potentially be another therapeutic target. APOC3 is a protein that in humans is encoded by the APOC3 gene. APOC3 is a component of VLDL. APOC3 inhibits lipoprotein lipase and hepatic lipase. It is also thought to inhibit hepatic uptake of triglyceride-rich particles. An increase in APOC3 levels induces the development of hypertriglyceridemia. Recent evidence suggests an intracellular role for APOC3 in promoting the assembly and secretion of triglyceride-rich VLDL particles from hepatic cells under lipid-rich conditions. However, two naturally occurring point mutations in human apoC3 coding sequence, A23T and K58E have been shown to abolish the intracellular assembly and secretion of triglyceride-rich VLDL particles from hepatic cells.

Targeted base editing with target genes involved in vascular disease and diabetes as described in Chadwick A C, Wang X, Musunuru K. In vivo base editing of PCSK9 (proprotein convertase subtilisin/kexin type 9) as a therapeutic alternative to genome editing. Arterioscler Thromb Vasc Biol, 2017, 37: 1741-7; Chadwick A C, Evitt N H, Lv W, et al. Reduced blood lipid levels with in vivo CRISPR-Cas9 base editing of ANGPTL3. Circulation, 2018, 137: 975-7; Rossidis A C, Stratigis J D, Chadwick A C, et al. In utero CRISPR-mediated therapeutic editing of metabolic genes. Nat Med, 2018, 24: 1513-8 is incorporated herein by reference in its entirety. While genes involved in lipid metabolism, including PCSK9, have been edited by targeted by current gene editing technologies, there remains a need for precise base editing targeting these genes for improved editing outcomes.

Pharmaceutical Composition

In some aspects, provided herein is a pharmaceutical composition comprising the base editor system as provided herein and a pharmaceutically acceptable carrier or excipient.

In some aspects, provided herein, is a pharmaceutical composition for gene modification comprising a gRNA or sgRNA described herein and a Base editor fusion protein or a nucleic acid sequence encoding the Base editor fusion protein and a pharmaceutically acceptable carrier. The composition for gene modification comprising a gRNA or sgRNA described herein and a Base editor fusion protein or a nucleic acid sequence encoding the Base editor fusion protein can be formulated into pharmaceutical compositions. Pharmaceutical compositions are formulated in a conventional manner using one or more pharmaceutically acceptable inactive ingredients that facilitate processing of the active compounds into preparations that can be used pharmaceutically. Suitable formulations for use in the present disclosure and methods of delivery are generally well known in the art. Proper formulation is dependent upon the route of administration chosen. A summary of pharmaceutical compositions described herein can be found, for example, in Remington: The Science and Practice of Pharmacy, Nineteenth Ed (Easton, Pa.: Mack Publishing Company, 1995); Hoover, John E., Remington's Pharmaceutical Sciences, Mack Publishing Co., Easton, Pennsylvania 1975; Liberman, H. A. and Lachman, L., Eds., Pharmaceutical Dosage Forms, Marcel Decker, New York, N.Y., 1980; and Pharmaceutical Dosage Forms and Drug Delivery Systems, Seventh Ed. (Lippincott Williams & Wilkins 1999), herein incorporated by reference for such disclosure.

A pharmaceutical composition can be a mixture of a gRNA or sgRNA described herein and a Base editor fusion protein or a nucleic acid sequence encoding the Base editor fusion protein with one or more of other chemical components (i.e., pharmaceutically acceptable ingredients), such as carriers, excipients, binders, filling agents, suspending agents, flavoring agents, sweetening agents, disintegrating agents, dispersing agents, surfactants, lubricants, colorants, diluents, solubilizers, moistening agents, plasticizers, stabilizers, penetration enhancers, wetting agents, anti-foaming agents, antioxidants, preservatives, or one or more combination thereof. The pharmaceutical composition facilitates administration of the gRNA or sgRNA described herein and the Base editor fusion protein or a nucleic acid sequence encoding the Base editor fusion protein to an organism or a subject in need thereof.

The pharmaceutical compositions of the present disclosure can be administered to a subject using any suitable methods known in the art. The pharmaceutical compositions described herein can be administered to the subject in a variety of ways, including parenterally, intravenously, intradermally, intramuscularly, colonically, rectally, or intraperitoneally. In some embodiments, the pharmaceutical compositions can be administered by intraperitoneal injection, intramuscular injection, subcutaneous injection, or intravenous injection of the subject. In some embodiments, the pharmaceutical compositions can be administered parenterally, intravenously, intramuscularly, or orally.

For administration by inhalation, the adenovirus described herein can be formulated for use as an aerosol, a mist, or a powder. For buccal or sublingual administration, the pharmaceutical compositions may be formulated in the form of tablets, lozenges, or gels formulated in a conventional manner. In some embodiments, the adenovirus described herein can be prepared as transdermal dosage forms. In some embodiments, the adenovirus described herein can be formulated into a pharmaceutical composition suitable for intramuscular, subcutaneous, or intravenous injection. In some embodiments, the adenovirus described herein can be administered topically and can be formulated into a variety of topically administrable compositions, such as solutions, suspensions, lotions, gels, pastes, medicated sticks, balms, creams, or ointments. In some embodiments, the adenovirus described herein can be formulated in rectal compositions such as enemas, rectal gels, rectal foams, rectal aerosols, suppositories, jelly suppositories, or retention enemas. In some embodiments, the adenovirus described herein can be formulated for oral administration such as a tablet, a capsule, or liquid in the form of aqueous suspensions or solutions selected from the group including, but not limited to, aqueous oral dispersions, emulsions, solutions, elixirs, gels, and syrups.

In some embodiments, the pharmaceutical composition for gene modification comprising a gRNA or sgRNA described herein and a Type II Cas protein or a nucleic acid sequence encoding the Type II Cas protein further comprises a therapeutic agent. The additional therapeutic agent may modulate different aspects of the disease, disorder, or condition being treated and provide a greater overall benefit than administration of either the replication competent recombinant adenovirus or the therapeutic agent alone. Therapeutic agents include, but are not limited to, a chemotherapeutic agent, a radiotherapeutic agent, a hormonal therapeutic agent, and/or an immunotherapeutic agent. In some embodiments, the therapeutic agent may be a radiotherapeutic agent. In some embodiments, the therapeutic agent may be a hormonal therapeutic agent. In some embodiments, the therapeutic agent may be an immunotherapeutic agent. In some embodiments, the therapeutic agent is a chemotherapeutic agent. Preparation and dosing schedules for additional therapeutic agents can be used according to manufacturers' instructions or as determined empirically by a skilled practitioner. For example, preparation and dosing schedules for chemotherapy are also described in The Chemotherapy Source Book, 4th Edition, 2008, M. C. Perry, Editor, Lippincott, Williams & Wilkins, Philadelphia, PA.

The subjects that can be treated with gene modification compositions of chemically modified gRNAs or sgRNAs described herein and a Type II Cas protein or a nucleic acid sequence encoding the Type II Cas protein and methods described herein can be any subject with a disease or a condition. For example, the subject may be a eukaryotic subject, such as an animal. In some embodiments, the subject is a mammal, e.g., human. In some embodiments, the subject is a human. In some embodiments, the subject is a non-human animal. In some embodiments, the subject is a fetus, an embryo, or a child. In some embodiments, the subject is a non-human primate such as chimpanzee, and other apes and monkey species; farm animals such as cattle, horses, sheep, goats, pigs; domestic animals such as rabbits, dogs, and cats; laboratory animals including rodents, such as rats, mice, and guinea pigs, and the like.

In some embodiments, the subject is prenatal (e.g., a fetus), a child (e.g., a neonate, an infant, a toddler, a preadolescent), an adolescent, a pubescent, or an adult (e.g., an early adult, a middle-aged adult, a senior citizen). The human subject can be between about 0 month and about 120 years old, or older. The human subject can be between about 0 and about 12 months old; for example, about 1, 2, 3, 4, 5, 6, 7, 8, 9, 10, 11, or 12 months old. The human subject can be between about 0 and 12 years old; for example, between about 0 and 30 days old; between about 1 month and 12 months old; between about 1 year and 3 years old; between about 4 years and 5 years old; between about 4 years and 12 years old; about 1, 2, 3, 4, 5, 6, 7, 8, 9, 10, 11, or 12 years old. The human subject can be between about 13 years and 19 years old; for example, about 13, 14, 15, 16, 17, 18, or 19 years old. The human subject can be between about 20 and about 39 years old; for example, about 20, 21, 22, 23, 24, 25, 26, 27, 28, 29, 30, 31, 32, 33, 34, 35, 36, 37, 38, or 39 years old. The human subject can be between about 40 to about 59 years old; for example, about 40, 41, 42, 43, 44, 45, 46, 47, 48, 49, 50, 51, 52, 53, 54, 55, 56, 57, 58, or 59 years old. The human subject can be greater than 59 years old; for example, about 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, or 120 years old. The human subjects can include male subjects and/or female subjects.

Lipid Nanoparticle (LNP) Composition

In some embodiments, LNPs are prepared in accordance with the methods described in Conway, A. et al. 2019 Mol. Ther. 27, 866-877, and Villiger, L. et al 2021 Nat. Biomed. Eng. 5, 179-18, which are incorporated by reference. In some embodiments, LNPs are composed of an amino lipid, a monomethoxypolyethylene glycol (or methoxypoluyethyle glycol) of average molecular weight 2000 Da conjugated to a lipid called PEG-Lipid, cholesterol and 1,2-distearoyl-sn-glycero-3-phosphocholine (DSPC). In some embodiments, LNPs are composed of proprietary ionizable cationic lipid, 1,2-distearoyl-sn-glycero-3-phosphocholine, cholesterol, and a PEG-lipid.

In some embodiments, LNPs have an average hydrodynamic diameter of about 30-about 160, about 35-about 160, about 40-about 160, about 45-about 160, about 50-about 160, about 55-about 160, about 60-about 160, about 65-about 160, about 70-about 160, about 75-about 160, about 80-about 160, about 85-about 160, about 90-about 160, about 95-about 160, about 100-about 160, about 105-about 160, about 110-about 160, about 115-about 160, about 120-about 160, about 125-about 160, about 130-about 160, about 135-about 160, about 140-about 160, about 145-about 160, about 150-about 160, about 30-about 155, about 30-about 150, about 30-about 145, about 30-about 140, about 30-about 135, about 30-about 130, about 30-about 125, about 30-about 120, about 30-about 115, about 30-about 110, about 30-about 105, about 30-about 100, about 30-about 95, about 30-about 90, about 30-about 85, about 30-about 80, about 30-about 75, about 30-about 70, about 30-about 65, about 30-about 60, about 30-about 55, about 30-about 50, about 30-about 45, about 30-about 40, about 30-about 45, about 35-about 45, about 35-about 50, about 40-about 50, about 40-about 55, about 45-about 55, about 45-about 60, about 50-about 60, about 50-about 65, about 55-about 60, about 55-about 65, about 55-about 70, about 60-about 70, about 60-about 75, about 65-about 75, about 65-about 80, about 70-about 80, about 70-about 85, about 75-about 85, about 75-about 90, about 80-about 90, about 80-about 95, about 85-about 95, about 85-about 100, about 90-about 100, about 90-about 105, about 95-about 105, about 95-about 110, about 100-about 110, about 100-about 115, about 105-about 115, about 105-about 120, about 110-about 120, about 110-about 125, about 115-about 125, about 115-about 130, about 120-about 130, about 120-about 135, about 125-about 135, about 125-about 140, about 130-about 140, about 130-about 145, about 35-about 140, about 45-about 130, about 55-about 120, about 65-about 110, about 75-about 100, or about 85-about 90 nm.

In some embodiments, LNPs comprise about 1-about 97, about 5-about 97, about 10-about 97, about 15-about 97, about 20-about 97, about 25-about 97, about 30-about 97, about 35-about 97, about 40-about 97, about 45-about 97, about 50-about 97, about 55-about 97, about 60-about 97, about 65-about 97, about 70-about 97, about 75-about 97, about 80-about 97, about 1-about 95, about 1-about 90, about 1-about 85, about 1-about 80, about 1-about 75, about 1-about 70, about 1-about 65, about 1-about 60, about 1-about 55, about 1-about 50, about 1-about 45, about 1-about 40, about 1-about 35, about 1-about 30, about 1-about 25, about 1-about 20, about 1-about 15, about 1-about 10, about 10-about 30, about 10-about 35, about 15-about 35, about 15-about 40, about 20-about 40, about 20-about 45, about 25-about 45, about 25-about 50, about 30-about 50, about 30-about 55, about 35-about 55, about 35-about 60, about 40-about 60, about 40-about 65, about 45-about 65, about 45-about 70, about 50-about 70, about 50-about 75, about 55-about 75, about 55-about 80, or about 60-about 80% of amino lipids (in mol %).

In some embodiments, LNPs comprise about 1-about 40, about 1-about 38, about 1-about 36, about 1-about 34, about 1-about 32, about 1-about 30, about 1-about 28, about 1-about 26, about 1-about 24, about 1-about 22, about 1-about 20, about 1-about 18, about 1-about 16, about 1-about 14, about 1-about 12, about 1-about 10, about 1-about 8, about 1-about 6, about 1-about 4, about 1-about 2, about 2-about 40, about 4-about 40, about 6-about 40, about 8-about 40, about 10-about 40, about 12-about 40, about 14-about 40, about 16-about 40, about 18-about 40, about 20-about 40, about 22-about 40, about 24-about 40, about 26-about 40, about 28-about 40, about 30-about 40, about 32-about 40, about 34-about 40, about 36-about 40, about 38-about 40, about 2-about 35, about 2-about 30, about 2-about 25, about 2-about 20, about 2-about 15, about 2-about 10, about 2-about 8, about 2-about 6, or about 2-about 4% DSPC (in mol %).

In some embodiments, LNPs comprise about 1-about 20, about 1-about 19, about 1-about 18, about 1-about 17, about 1-about 16, about 1-about 15, about 1-about 14, about 1-about 13, about 1-about 12, about 1-about 11, about 1-about 10, about 1-about 9, about 1-about 8, about 1-about 7, about 1-about 6, about 1-about 5, about 1-about 4, about 1-about 3, about 2-about 6, about 3-about 7, about 4-about 8, about 5-about 9, about 6-about 10, about 7-about 11, about 8-about 12, about 9-about 13, about 10-about 14, about 11-about 15, about 12-about 16, about 13-about 17, about 14-about 18, about 15-about 19, or about 16-about 20% PEG-Lipid (in mol %), In some embodiments, LNPs comprise about 1-about 97, about 5-about 97, about 10-about 97, about 15-about 97, about 20-about 97, about 25-about 97, about 30-about 97, about 35-about 97, about 40-about 97, about 45-about 97, about 50-about 97, about 55-about 97, about 60-about 97, about 65-about 97, about 70-about 97, about 75-about 97, about 80-about 97, about 1-about 95, about 1-about 90, about 1-about 85, about 1-about 80, about 1-about 75, about 1-about 70, about 1-about 65, about 1-about 60, about 1-about 55, about 1-about 50, about 1-about 45, about 1-about 40, about 1-about 35, about 1-about 30, about 1-about 25, about 1-about 20, about 1-about 15, about 1-about 10, about 10-about 30, about 10-about 35, about 15-about 35, about 15-about 40, about 20-about 40, about 20-about 45, about 25-about 45, about 25-about 50, about 30-about 50, about 30-about 55, about 35-about 55, about 35-about 60, about 40-about 60, about 40-about 65, about 45-about 65, about 45-about 70, about 50-about 70, about 50-about 75, about 55-about 75, about 55-about 80, or about 60-about 80% of cholesterol (in mol %).

In some embodiments, LNPs comprise about 1-about 97, 5-about 97, 10-about 97, 15-about 97, 20-about 97, 25-about 97, 30-about 97, 35-about 97, 40-about 97, 45-about 97, 50-about 97, 55-about 97, 60-about 97, 65-about 97, 70-about 97, 75-about 97, 80-about 97, 1-about 95, 1-about 90, 1-about 85, 1-about 80, 1-about 75, 1-about 70, 1-about 65, 1-about 60, 1-about 55, 1-about 50, 1-about 45, 1-about 40, 1-about 35, 1-about 30, 1-about 25, 1-about 20, 1-about 15, 1-about 10, 10-about 30, 10-about 35, 15-about 35, 15-about 40, 20-about 40, 20-about 45, 25-about 45, 25-about 50, 30-about 50, 30-about 55, 35-about 55, 35-about 60, 40-about 60, 40-about 65, 45-about 65, 45-about 70, 50-about 70, 50-about 75, 55-about 75, 55-about 80, or 60-about 80% of amino lipids; 1-about 40, 1-about 38, 1-about 36, 1-about 34, 1-about 32, 1-about 30, 1-about 28, 1-about 26, 1-about 24, 1-about 22, 1-about 20, 1-about 18, 1-about 16, 1-about 14, 1-about 12, 1-about 10, 1-about 8, 1-about 6, 1-about 4, 1-about 2, 2-about 40, 4-about 40, 6-about 40, 8-about 40, 10-about 40, 12-about 40, 14-about 40, 16-about 40, 18-about 40, 20-about 40, 22-about 40, 24-about 40, 26-about 40, 28-about 40, 30-about 40, 32-about 40, 34-about 40, 36-about 40, 38-about 40, 2-about 35, 2-about 30, 2-about 25, 2-about 20, 2-about 15, 2-about 10, 2-about 8, 2-about 6, or 2-about 4% DSPC; 1-about 20, 1-about 19, 1-about 18, 1-about 17, 1-about 16, 1-about 15, 1-about 14, 1-about 13, 1-about 12, 1-about 11, 1-about 10, 1-about 9, 1-about 8, 1-about 7, 1-about 6, 1-about 5, 1-about 4, 1-about 3, 2-about 6, 3-about 7, 4-about 8, 5-about 9, 6-about 10, 7-about 11, 8-about 12, 9-about 13, 10-about 14, 11-about 15, 12-about 16, 13-about 17, 14-about 18, 15-about 19, and about 16-about 20% PEG-Lipid, with the balance being cholesterol (all in mol %).

Amino Lipid

Described herein are LNP compositions comprising an amino lipid, a phospholipid, a PEGlipid, a cholesterol or a derivative thereof, a payload, or any combination thereof. In some embodiments, the LNP composition comprises an amino lipid. In one aspect, disclosed herein is an amino lipid having the structure of Formula (I), or a pharmaceutically acceptable salt or solvate thereof,

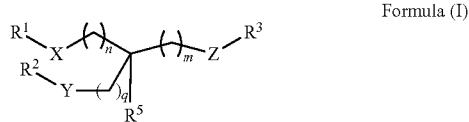

Formula (I)

wherein
each of $R^1$ and $R^2$ is independently $C_7$-$C_{22}$ alkyl, $C_7$-$C_{22}$ alkenyl, $C_3$-$C_8$ cycloalkyl, —$C_2$-$C_{10}$ allkylene-L-$R^6$, or

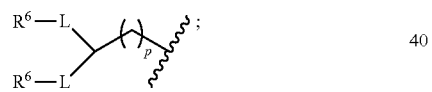

wherein each of the alkyl, alkylene, alkenyl, and cycloalkyl is independently substituted or unsubstituted;
each of X, Y, and Z is independently —C(=O)NR$^4$—, —NR$^4$C(=O)—, —C(=O)O—, —OC(=O)—, —OC(=O)O—, —NR$^4$C(=O)O—, —OC(=O)NR$^4$—, —NR$^4$C(=O)NR$^4$—, —NR$^4$C(=NR$^4$)NR$^4$—, —C(=S)NR$^4$—, —NR$^4$C(=S)—, —C(=O)O—, —OC(=S)—, OC(=S)O—, —NR$^4$C(=S)O—, —OC(=S)NR$^4$—, —NR$^4$C(=S)NR$^4$—, —C(=O)S—, —SC(=O)—, —OC(=O)S—, —NR$^4$C(=O)S—, —SC(=O)NR$^4$—, —C(=S)S—, —SC(=S)—, —SC(=S)O—, —NR$^4$C(=S)S—, —SC(=S)NR$^4$—, —C(=S)S—, —SC(=S)—, —SC(=O)S—, —SC(=S)S—, —NR$^4$C(=S)S—, —SC(=S)NR$^4$— O, S, or a bond;
each of L is independently —C(=O)NR$^4$—, —NR$^4$C(=O)—, —C(=O)O—, —OC(=O)O—, —NR$^4$C(=O)O—, —OC(=O)NR$^4$—, —NR$^4$C(=O)NR$^4$—, —NR$^4$C(=NR$^4$)NR$^4$—, —C(=S)NR$^4$—, —NR$^4$C(=S)—, —C(=O)O—, —OC(=S)—, OC(=S)O—, —NR$^4$C(=S)O—, —OC(=S)NR$^4$—, —NR$^4$C(=S) NR$^4$—, —C(=O)S—, SC(=O)—, —OC(=O)S—, —NR$^4$C(=O)S—, —SC(=O)NR$^4$—, —C(=S)S—, —SC(=S)—, —SC(=S)O—, —NR$^4$C(=S)S—, —SC(=S)NR$^4$—, —C(=S)S—, —SC(=S)—, —SC(=O)S—, —SC(=S)S—, —NR$^4$C(=S)S—, —SC(=S)NR$^4$—, O, S, —$C_1$-$C_{10}$ alkylene-O—, —$C_1$-$C_{10}$ alkylene-C(=O)O—, —$C_1$-$C_{10}$ alkylene-OC(=O)—, or a bond,
wherein the alkylene is substituted or unsubstituted;
$R^3$ is —$C_0$-$C_{10}$ alkylene-NR$^7$R$^8$, —$C_0$-$C_{10}$ alkylene-heterocycloalkyl, or —$C_0$-$C_{10}$ alkylene-heterocycloaryl,
wherein the alkylene, heterocycloalkyl and heterocycloaryl is independently substituted or unsubstituted;
each of R$^4$ is independently hydrogen or substituted or unsubstituted $C_1$-$C_6$ alkyl;
R$^5$ is hydrogen or substituted or unsubstituted $C_1$-$C_6$ alkyl;
each of R$^6$ is independently substituted or unsubstituted $C_3$-$C_{22}$ alkyl or substituted or unsubstituted $C_3$-$C_{22}$ alkenyl;
each of R$^7$ and R$^8$ is independently hydrogen or substituted or unsubstituted $C_1$-$C_6$ alkyl, or R$^7$ and R$^8$ taken together with the nitrogen to which they are attached form a substituted or unsubstituted $C_2$-$C_6$ heterocyclyl;
p is an integer selected from 1 to 10; and
each of n, m, and q is independently 0, 1, 2, 3, 4, or 5.

In some embodiments of Formula (I), if the structure carries more than one asymmetric C-atom, each asymmetric C-atom independently represents racemic, chirally pure R and/or chirally pure S isomer, or a combination thereof.

In some embodiments, each of n, in, and q in Formula (I) is independently 0, 1, 2, or 3. In some embodiments, each of n, m, and q in Formula (I) is 1.

In some embodiments, the compound of Formula (1) has a structure of Formula (Ia), or a pharmaceutically acceptable salt or pharmaceutically acceptable solvate thereof:

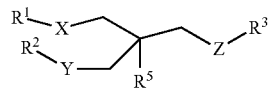

Formula (Ia)

wherein
each of $R^1$ and $R^2$ is independently $C_7$-$C_{22}$ alkyl, $C_7$-$C_{22}$ alkenyl, $C_3$-$C_5$ cycloalkyl, —$C_2$-$C_{10}$ alkylene-L-$R^6$, or

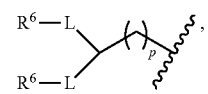

wherein each of the alkyl, alkylene, alkenyl, and cycloalkyl is independently substituted or unsubstituted;
each of X, Y, and Z is independently C(=O)NR$^4$—, —NR$^4$C(D)-, —C(=O)O—, —OC(=O)—, —OC(=O)O—, —NR$^4$C(=O)O—, —OC(=O)NR$^4$—, —NR$^4$C=O)NR$^4$—, —NR$^4$C(=NR$^4$)NR$^4$—. —C(=S)NR$^4$—, —NR$^4$C(=S)—, —C(E)O—, —OC(=S)—, OC(=S)O—, —NR$^4$C(=S)O—, —OC(=S) NR$^4$—, —NR$^4$C(=S)NR$^4$—, —C(=O)S—, —SC(=O)—, —OC(=O)S—, —NR$^4$C(=O)S—, —SC(=O)NR$^4$—, —C(=S)S—, —SC(=S)—, —SC(=S)O—, —NR$^4$C(=S)S—, —SC(=S)NR$^4$—, —C(=S)S—. —SC(=S)—, —SC(=O)S—, —SC(=S)S—, —NR⁴C(=S)S—, —SC(=S)NR⁴—, O, S, —C₁-C₁₀ alkylene-O—, or a bond, wherein the alkylene is substituted or unsubstituted;

each of L is independently —C(=O)NR⁴—, —NR⁴C(=O)—, —C(=O)O—, —OC(=O)—, —OC(=O)O—, —NR⁴C(=O)O—, —OC(=O)NR⁴—, —NR⁴C(=O)NR⁴—, —NR⁴C(=NR⁴)NR⁴—, —C(=S)NR⁴—, —NR⁴C(=S)—, —C(=O)O—, —OC(=S)—, OC(=S)O—, —NR⁴C(=S)O—, —OC(=S)NR⁴—, —NR⁴C(=S)NR⁴—, —C(=O)S—, —SC(=O)—, —OC(=O)S—, —NR⁴C(=O)S—, —SC(=O)NR⁴— —C(=S)S—, —SC(=S)—, —SC(=S)O—, —NR⁴C(=S)S—, —SC(=S)NR⁴—, —C(=S)S—, —SC(=S)—, —SC(=O)S—, —SC(=S)S—, —NR⁴C(=S)S—, —SC(=S)NR⁴—, O, S. —C₁-C₁₀ alkylene-O—, —C₁-C₁₀ alkylene-C(=O)O—, —C₁-C₁₀ alkylene-OC(=O)—, or a bond, wherein the alkylene is substituted or unsubstituted; $R^3$ is —C₀-C₁₀ alkylene-NR⁷R8, —C₀-C₁₀ alkylene-heterocycloalkyl, or —C₀-C₁₀ alkylene-heterocyclowyl, wherein the alkylene, heterocycloalkyl and heterocycloaryl is independently substituted or unsubstituted;

each of $R^4$ is independently hydrogen or substituted or unsubstituted CI-C6 alkyl; $R^5$ is hydrogen or substituted or unsubstituted $C_1$-$C_6$ alkyl;

each of $R^6$ is independently substituted or unsubstituted $C_3$-$C_{22}$ alkyl or substituted or unsubstituted $C_3$-$C_{22}$ alkenyl;

each of $R^7$ and $R^8$ is independently hydrogen or substituted or unsubstituted $C_1$-$C_6$ alkyl, or $R^7$ and $R^8$ taken together with the nitrogen to which they are attached form a substituted or unsubstituted $C_2$-$C_6$ heterocyclyl; and p is an integer selected from 1 to 10.

In some embodiments of Formula (Ia), if the structure carries more than one asymmetric Catom, each asymmetric C-atom independently represents racemic, chirally pure R and/or chirally pure S isomer, or a combination thereof.

In some embodiments, $R^1$ and $R^2$ in Formula (I) and Formula (Ia) is independently $C_7$-$C_{22}$ alkyl, $C_7$-$C_{22}$ alkenyl, —$C_2$-$C_{10}$ alkylene-L-$R^6$, or

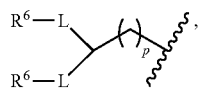

wherein each of the alkyl, alkylene, alkenyl, and cycloalkyl is independently substituted or unsubstituted. In some embodiments, $R^1$ and $R^2$ in Formula (I) and Formula (Ia) is independently $C_{10}$-$C_{20}$ alkyl, $C_{10}$-$C_{20}$ alkenyl, $C_8$-$C_7$alkylene-L-$R^6$, or

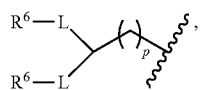

wherein each of the alkyl, alkylene, alkenyl, and cycloalkyl is independently substituted or unsubstituted. In some embodiments, $R^1$ in Formula (I) and Formula (Ia) is

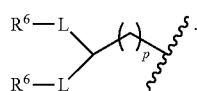

In some embodiments, each of L in Formula (I) and Formula (Ia) is independently O, S, —$C_1$-$C_{10}$ alkylene-O—, —$C_1$-$C_{10}$ alkylene-C(=O)O—, —$C_1$-$C_{10}$ alkylene-OC(=O)—, or a bond, wherein the alkylene is substituted or unsubstituted. In some embodiments, each of L in Formula (I) and Formula (Ia) is independently O, S, —$C_1$-$C_3$ alkylene-O—, —$C_1$-$C_3$ alkylene-C(=O)O—, —$C_1$-$C_3$ alkylene-OC(=O)—, or a bond, wherein the alkylene is substituted or unsubstituted. In some embodiments, each of L in Formula (I) and Formula (Ia) is independently O, S, —$C_1$-$C_3$ alkylene-O—, —$C_1$-$C_3$ alkylene-C(=O)O—, —$C_1$-$C_3$ alkylene-OC(=O)—, or a bond, wherein the alkylene is linear or branched unsubstituted alkylene.

In some embodiments, each of $R^6$ in Formula (I) and Formula (Ia) is independently substituted or unsubstituted linear $C_3$-$C_{22}$ alkyl or substituted or unsubstituted linear $C_3$-$C_{22}$ alkenyl. In some embodiments, each of $R^6$ in Formula (I) and Formula (Ia) is independently substituted or unsubstituted $C_3$-$C_{20}$ alkyl or substituted or unsubstituted $C_3$-$C_{20}$ alkenyl. In some embodiments, each of $R^6$ in Formula (I) and Formula (Ia) is independently substituted or unsubstituted $C_3$-$C_{10}$ alkyl or substituted or unsubstituted $C_3$-$C_{10}$ alkenyl. In some embodiments, each of $R^6$ in Formula (I) and Formula (Ia) is independently substituted or unsubstituted $C_3$-$C_{10}$ alkyl. In some embodiments, each of $R^6$ in Formula (I) and Formula (Ia) is independently substituted or unsubstituted linear $C_3$-$C_{10}$ alkyl. In some embodiments, each of $R^6$ in Formula (I) and Formula (Ia) is independently substituted or unsubstituted n-pentyl, n-hexyl, n-heptyl, n-octyl, n-nonyl, n-decyl, n-undecyl, or n-dodecyl. In some embodiments, each of $R^6$ in Formula (I) and Formula (Ia) is independently substituted or unsubstituted n-octyl. In some embodiments, each of $R^6$ in Formula (I) and Formula (Ia) is n-octyl.

In some embodiments, each of L in Formula (I) and Formula (Ia) is independently —C(=O)O—, —OC(=O)—, —$C_1$-$C_{10}$ alkylene-O—, or O. In some embodiments, each of L in Formula (I) and Formula (Ia) is O. In some embodiments, each of L in Formula (I) and Formula (Ia) is —$C_1$-$C_3$ alkylene-O—. In some embodiments, p in Formula (I) and Formula (Ia) is 1, 2, 3, 4, or 5. In some embodiments, p in Formula (I) and Formula (Ia) is 2.

In some embodiments, $R^1$ in Formula (I) and Formula (Ia) is

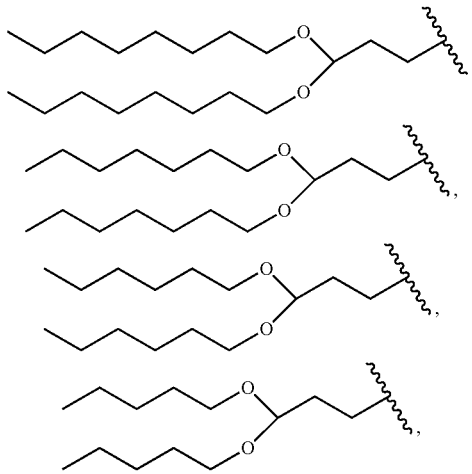

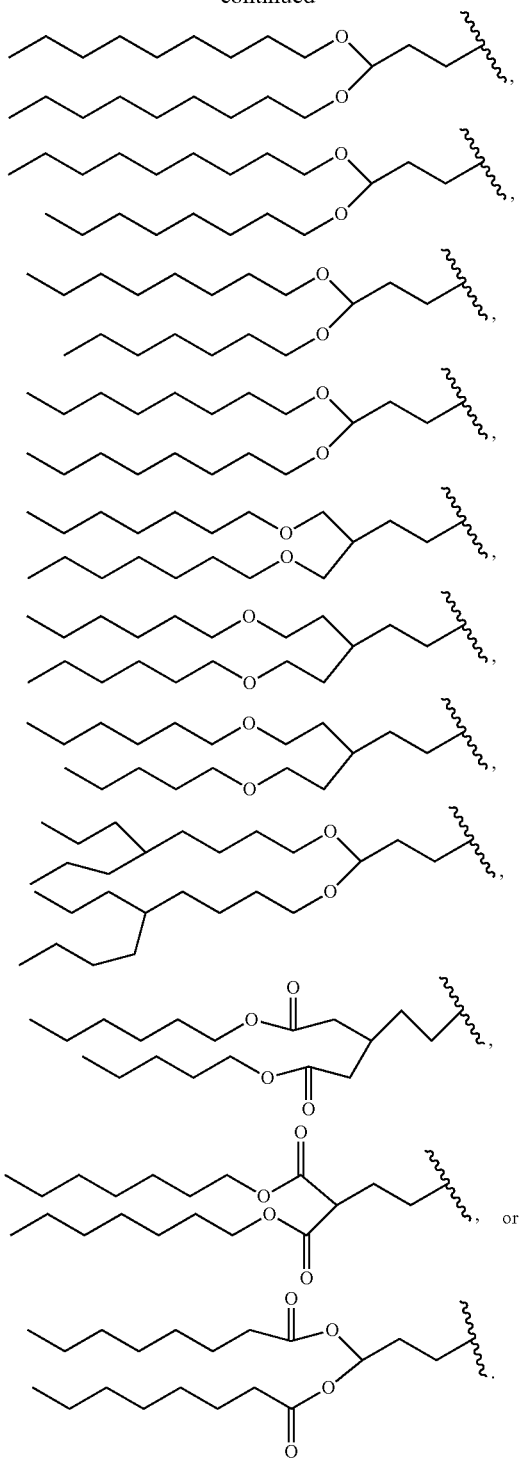

In some embodiments, each of $R^4$ in Formula (I) and Formula (Ia) is independently H or substituted or unsubstituted $C_1$-$C_4$ alkyl. In some embodiments, each of $R^4$ in Formula (I) and Formula (Ia) is independently substituted or unsubstituted linear $C_1$-$C_4$ alkyl. In some embodiments, each of $R^4$ in Formula (I) and Formula (Ia) is H. In some embodiments, each of $R^4$ in Formula (I) and Formula (Ia) is independently H, —$CH_3$, —$CH_2CH_3$, —$CH_2CH_2CH_3$, or —$CH(CH_3)_2$. In some embodiments, each of $R^4$ in Formula (I) and Formula (Ia) is independently H or —CH3. In some embodiments, each of $R^4$ in Formula (1) and Formula (1a) is —$CH_3$.

In some embodiments, X in Formula (I) and Formula (Ia) is —C(=O)O— or —OC(=O))—. In some embodiments, X in Formula (I) and Formula (Ia) is —C(=O)NR$^4$— or —NR$^4$C(=O)—. In some embodiments, X in Formula (I) and Formula (Ia) is —C(=O)N(CH$_3$)—, —N(CH$_3$)C(=O)—, —C(=O)NH—, or —NHC(=O)—. In some embodiments, X in Formula (I) and Formula (Ia) is —C(=O))NH—, —C(=O)N(CH$_3$)—. —OC(=O))—, —NHC(=O)—, —N(CH$_3$)C(=O))—, —C(=O)O—, —OC(=O)O—, —NHC(=O)O—, —N(CH$_3$)C(=O)O—, —OC(=O))NH—, —OC(=O)N(CH$_3$)—, —NHC(=O)NH—, —N(CH$_3$)C(=O))NH—, —NHC(=O)N(CH$_3$)—, —N(CH$_3$)C(=O)N(CH$_3$)—, NHC(=NH)NH—, —N(CH$_3$)C(=NH)NH—, —NHC(=NH)N(CH$_3$)—, —N(CH$_3$)C(=NH)N(CH$_3$)—, NHC(=NMe)NH—, —N(CH$_3$)C(=NMe)NH—, —NHC(=NMe)N(CH$_3$)—, or —N(CH$_3$)C(=NMe)N(CH$_3$)—.

In some embodiments. $R^2$ in Formula (I) and Formula (Ia) is $C_7$-$C_{22}$ alkyl, $C_7$-$C_{22}$ alkenyl, —$C_2$-$C_{10}$ alkylene-L-$R^6$, or

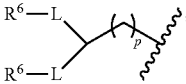

wherein each of the alkyl, alkylene, alkenyl, and cycloalkyl is independently substituted or unsubstituted. In some embodiments, $R^2$ in Formula (I) and Formula (Ia) is substituted or unsubstituted $C_7$-$C_{22}$ alkyl or substituted or unsubstituted $C_7$-$C_{22}$ alkenyl. In some embodiments, $R^2$ in Formula (I) and Formula (Ia) is substituted or unsubstituted linear $C_7$-$C_{22}$ alkyl or substituted or unsubstituted linear $C_7$-$C_{22}$ alkenyl. In some embodiments, $R^2$ in Formula (I) and Formula (Ia) is substituted or unsubstituted $C_{10}$-$C_{20}$ alkyl or substituted or unsubstituted $C_{10}$-$C_{20}$ alkenyl. In some embodiments, $R^2$ in Formula (I) and Formula (Ia) is unsubstituted $C_{10}$-$C_{20}$ alkyl. In some embodiments, $R^2$ in Formula (I) and Formula (Ia) is unsubstituted $C_{10}$-$C_{20}$ alkenyl. In some embodiments, $R^2$ in Formula (I) and Formula (Ia) is —$C_2$-$C_{10}$ alkylene-L-$R^6$. In some embodiments, $R^2$ in Formula (I) and Formula (Ia) is —$C_2$-$C_{10}$ alkylene-C(=O)O—$R^6$ or —$C_2$-$C_{10}$ alkylene-OC(=O)—$R^6$.

In some embodiments, $R^2$ in Formula (I) and Formula (Ia) is

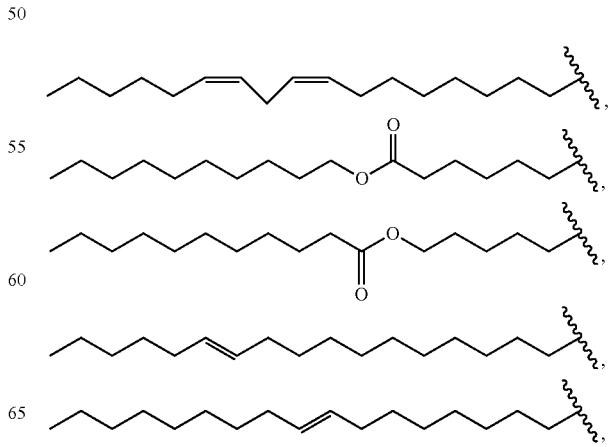

-continued

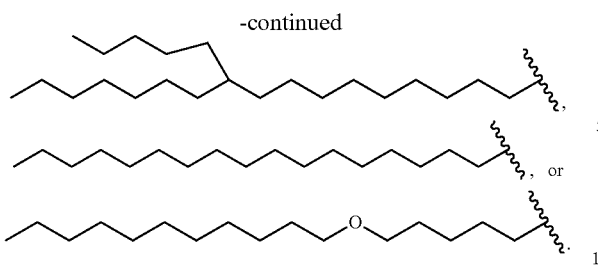

In some embodiments, Y in Formula (I) and Formula (Ia) is —C(=O)O— or —OC(=O)—. In some embodiments, Y in Formula (I) and Formula (Ia) is —C(=O)NR$^4$— or —NR$^4$C(=O)—. In some embodiments, Y in Formula (I) and Formula (Ia) is —C(=O)N(CH$_3$)—, —N(CH$_3$)C(=O)—, —C(=O)NH—, or —NHC(=O)—. In some embodiments, Y in Formula (I) and Formula (Ia) is —OC(=O)O—, —NR$^4$C(=O)O—, —OC(=O)NR$^4$—, or —NR4C(=O)NR$^4$—. In some embodiments. Y in Formula (I) and Formula (Ia) is —OC(=O)O—, —NHC(=O)O—, —OC(=O)NH—, —NHC(=O)NH—, —N(CH$_3$)C(=O)O—. —OC(=O)N(CH$_3$)—, —N(CH$_3$)C(=O)N(CH$_3$)— or —N(CH$_3$)C(=O)NH—. In some embodiments, Y in Formula (I) and Formula (Ia) is —OC(=O)O—, —NHC(=O)O—, —OC(=O)NH—, or —NHC(=O)NH—.

In some embodiments, R$^3$ in Formula (I) and Formula (Ia) is —C$_0$-C$_{10}$ alkylene-NR$^7$R' or —C$_0$-C$_{10}$ alkylene-heterocycloalkyl, wherein the alkylene and heterocycloalkyl is independently substituted or unsubstituted. In some embodiments, R$^3$ in Formula (I) and Formula (Ta) is —C$_0$-C$_{10}$ alkylene-NR 7R$^8$. Tn some embodiments, R$^3$ in Formula (I) and Formula (Ia) is —C$_1$-C$_6$ alkylene-NR$^7$R$^8$. In some embodiments, R$^3$ in Formula (I) and Formula (Ia) is —C$_1$-C$_4$ alkylene-NR$^7$R$^8$. In some embodiments, R$^3$ in Formula (I) and Formula (Ia) is —C$_1$— alkylene-NR$^7$R$^8$. In some embodiments, R$^3$ in Formula (I) and Formula (Ia) is —C$_2$— -alkylene-NR 7R$^8$. Tn some embodiments, R$^3$ in Formula (I) and Formula (Ia) is —C$_3$— alkylene-NR 7R$^8$. In some embodiments, R$^3$ in Formula (I) and Formula (Ia) is —C$_4$- alkylene-NR$^7$R$^8$. In some embodiments, R$^3$ in Formula (I) and Formula (Ia) is —C$_5$— alkylene-NR$^7$R'. In some embodiments, R$^3$ in Formula (I) and Formula (Ia) is —C$_0$-C$_{10}$ alkylene-heterocycloalkyl. In some embodiments, R$^3$ in Formula (I) and Formula (Ia) is —C$_1$-C$_6$ alkylene-heterocycloalkyl, wherein the heterocycloalkyl comprises 1 to 3 nitrogen and 0-2 oxygen. In some embodiments, R$^3$ in Formula (I) and Formula (Ia) is —C$_1$-C$_6$ alkylene-heterocycloaryl.

In some embodiments, each of R$^7$ and R$^8$ in Formula (I) and Formula (Ia) is independently hydrogen or substituted or unsubstituted C$_1$-C$_6$ alkyl. Tn some embodiments, each of R$^7$ and R$^8$ is independently hydrogen or substituted or unsubstituted C$_1$-C$_3$ alkyl. In some embodiments, each of R$^7$ and R$^8$ is independently substituted or unsubstituted C$_1$-C$_3$ alkyl. In some embodiments, each of R$^7$ and R$^8$ is independently —CH$_3$, —CH$_2$CH$_3$, —CH$_2$CH$_2$CH$_3$, or —CH(CH$_3$)$_2$. In some embodiments, each of R and R$^8$ is CH$_3$. In some embodiments, each of R$^7$ and R$^8$ is —CH$_2$CH$_3$.

In some embodiments, R$^7$ and R$^8$ in Formula (I) and Formula (Ia) taken together with the nitrogen to which they are attached form a substituted or unsubstituted C$_2$-C$_6$ heterocyclyl. In some embodiments, R$^7$ and R$^8$ taken together with the nitrogen to which they are attached form a substituted or unsubstituted C$_2$-C$_6$ heterocycloalkyl. In some embodiments, R$^7$ and R$^8$ taken together with the nitrogen to which they are attached form a substituted or unsubstituted 3-7 membered heterocycloalkyl.

In some embodiments, R$^3$ in Formula (I) and Formula (Ia) is

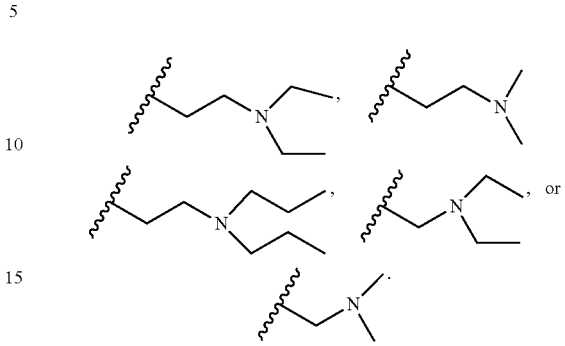

In some embodiments. R$^3$ in Formula (I) and Formula (Ia) is

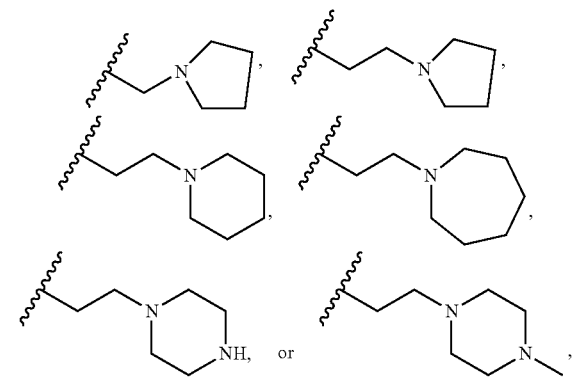

In some embodiments. R$^3$ in Formula (1) and Formula (1a) is

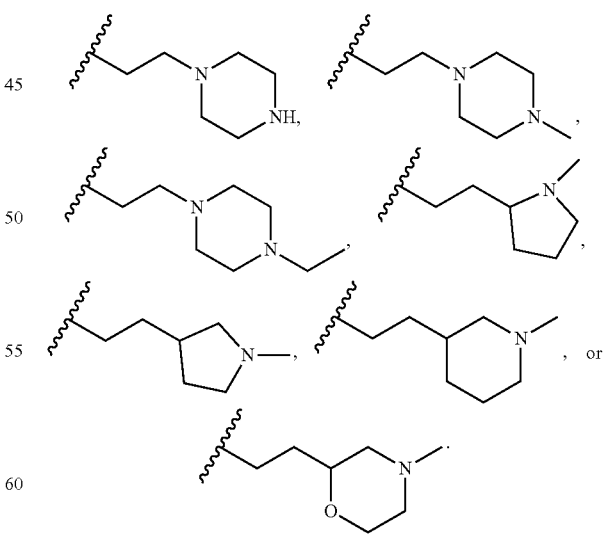

In some embodiments, Z in Formula (I) and Formula (Ia) is —C(=O)O— or —OC(=O)—. In some embodiments, Z in Formula (1) and Formula (1a) is —C(=O)NR$^4$— or —NR$^4$C(=O)—. In some embodiments, Z in Formula (I)

and Formula (Ia) is —C(=O)N(CH₃)—, —N(CH₃)C(=O)—, —C(=O)NH—, or —NHC(=O)—. In some embodiments, Z in Formula (I) and Formula (Ia) is —OC(=O)O—, —NR⁴C(=O)O—, —OC(O)NR⁴—, or —NR⁴C(=O)NR⁴—. In some embodiments, Z in Formula (I) and Formula (Ia) is —OC(=O)O—, —NHC(=O)O—, —OC(=O)NH—, —NHC(=O)NH—, —N(CH₃)C(=O)O—, —OC(=O)N(CH₃)—, —N(CH₃)C(=O)N(CH₃)—, —NHC(=O)N(CH₃)— or —N(CH₃)C(=O)NH—. In some embodiments, Y in Formula (I) and Formula (Ia) is —OC(=O)O—, —NHC(=O)O—, —OC(=O)NH—, or —NHC(=O)NH—.

In some embodiments, R⁵ in Formula (I) and Formula (Ia) is hydrogen or substituted or unsubstituted C₁-C₃ alkyl. In some embodiments, R⁵ in Formula (I) and Formula (Ia) is H, —CH₃, —CH—)CH₃, —CH₂CH₂CH₃, or —CH(CH₃)₂. In some embodiments, R⁵ in Formula (I) and Formula (Ia) is H.

In some embodiments, the LNP comprises a plurality of amino lipids. For example, the LNP composition can comprise 2, 3, 4, 5, 6, 7, 8, 9, 10, or more amino lipids. For another example, the LNP composition can comprise at least 2, at least 3, at least 4, at least 5, at least 6, at least 7, at least 9, at least 10, or at least 20 amino lipids. For yet another example, the LNP composition can comprise at most 2, at most 3, at most 4, at most 5, at most 6, at most 7, at most 9, at most 10, at most 20, or at most 30 amino lipids.

In some embodiments, the LNP composition comprises a first amino lipid. In some embodiments, the LNP composition comprises a first amino lipid and a second amino lipid. In some embodiments, the LNP composition comprises a first amino lipid, a second amino lipid, and a third amino lipid. In some embodiments, the LNP composition comprises a first amino lipid, a second amino lipid, a third amino lipid, and a fourth amino lipid. In some embodiments, the LNP composition does not comprise a fourth amino lipid. In some embodiments, the LNP composition does not comprise a third amino lipid. In some embodiments, a molar ratio of the first amino lipid to the second amino lipid is from about 0.1 to about 10. In some embodiments, a molar ratio of the first amino lipid to the second amino lipid is from about 0.20 to about 5. In some embodiments, a molar ratio of the first amino lipid to the second amino lipid is from about 0.25 to about 4. In some embodiments, a molar ratio of the first amino lipid to the second amino lipid is about 0.25, about 0.33, about 0.5, about 1, about 2, about 3, or about 4.

In some embodiments, a molar ratio of the first amino lipid:the second amino lipid:the third amino lipid is about 4:1:1. In some embodiments, a molar ratio of the first amino lipid:the second amino lipid:the third amino lipid is about 1:1:1. In some embodiments, a molar ratio of the first amino lipid:the second amino lipid:the third amino lipid is about 2:1:1. In some embodiments, a molar ratio of the first amino lipid:the second amino lipid:the third amino lipid is about 2:2:1. In some embodiments, a molar ratio of the first amino lipid: the second amino lipid:the third amino lipid is about 3:2:1. In some embodiments, a molar ratio of the first amino lipid:the second amino lipid:the third amino lipid is about 3:1:1. In some embodiments, a molar ratio of the first amino lipid:the second amino lipid:the third amino lipid is about 5:1:1. In some embodiments, a molar ratio of the first amino lipid:the second amino lipid:the third amino lipid is about 3:3:1. In some embodiments, a molar ratio of the first amino lipid:the second amino lipid:the third amino lipid is about 4:4:1.

In some embodiments, the LNP composition comprises one or more amino lipids. In some embodiments, the one or more amino lipids comprise from about 40 mol % to about 65 mol % of the total lipid present in the particle. In some embodiments, the one or more amino lipids comprise about 40 mol %, about 41 mol %, about 42 mol %, about 43 mol %, about 44 mol %, about 45 mol %, about 46 mol %, about 47 mol %, about 48 mol %, about 49 mol %, about 50 mol %, about 51 mol %, about 52 mol %, about 53 mol %, about 54 mol %, about 55 mol %, about 56 mol %, about 57 mol %, about 58 mol %, about 59 mol %, about 60 mol %, about 61 mol %, about 62 mol %, about 63 mol %, about 64 mol %, or about 65 mol % of the total lipid present in the particle. In some embodiments, the first amino lipid comprises from about 1 mol % to about 99 mol % of the total amino lipids present in the particle. In some embodiments, the first amino lipid comprises from about 16.7 mol % to about 66.7 mol % of the total amino lipids present in the particle. In some embodiments, the first amino lipid comprises from about 20 mol % to about 60 mol % of the total amino lipids present in the particle.

In some embodiments, the amino lipid is an ionizable lipid. An ionizable lipid can comprise one or more ionizable nitrogen atoms. In some embodiments, at least one of the one or more ionizable nitrogen atoms is positively charged. Tn some embodiments, at least 10 mol %, 20 mol %, 30 mol %, 40 mol %, 50 mol %, 60 mol %, 70 mol %, 80 mol %. 90 mol %, 95 mol %, or 99 mol % of the ionizable nitrogen atoms in the LNP composition are positively charged. In some embodiments, the amino lipid comprises a primary amine, a secondary amine, a tertiary amine, an imine, an amide, a guanidine moiety, a histidine residue, a lysine residue, an arginine residue, or any combination thereof. In some embodiments, the amino lipid comprises a primary amine, a secondary amine, a tertiary amine, a guanidine moiety, or any combination thereof. In some embodiments, the amino lipid comprises a tertiary amine.

In some embodiments, the amino lipid is a cationic lipid. Tn some embodiments, the amino lipid is an ionizable lipid. In some embodiments, the amino lipid comprises one or more nitrogen atoms. In some embodiments, the amino lipid comprises one or more ionizable nitrogen atoms. Exemplary cationic and/or ionizable lipids include, but are not limited to, 3-(didodecylamino)-N1,N1,4-tri dodecyl-1-piperazineethan amine (KL10), N142-(didodecylamino)ethyl]-N1,N4, N4-tridodecyl-1,4-piperazinediethanamine (KL22), 14,25-ditridecyl-15,18,21,24-tetraaza-octatriacontane (KL25), 1,2-dilinoleyloxy-N,N-dimethylaminopropane (DLin-DMA), 2,2-dilinoleyl-4-dimethylaminomethyl-[1,3]-dioxolane (DLin-K-DMA), heptatriaconta-6,9,28,31-tetraen-19-yl 4-(dimethylamino)butanoate (DLin-MC 3-DMA), 2,2-dilinoleyl-4-(2-dimethylaminoethyl)-[1,3]-dioxolane (DLin-KC2-DMA), 1,2-dioleyloxy-N,N-dimethylaminopropane (DODMA), 2-({8-[(3p)-cholest-5-en-3-yloxy]octyl}oxy)-N,N-dimethyl-3-[(9Z,12Z)-octadeca-9,12-dien-1-yloxy]propan-1-amine (Octyl-CLinDMA), (2R)-2-({8-[(3p)-cholest-5-en-3-yloxy]octyl}oxy)-N,N-dimethyl-3-[(9Z,12Z)-octadeca-9,12-dien-1-yloxy]propan-1-amine (Octyl-CLinDMA (2R)), and (2S)-2-({8-[(33)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)).

In some embodiments, an amino lipid described herein can take the form of a salt, such as a pharmaceutically acceptable salt. All pharmaceutically acceptable salts of the amino lipid are encompassed by this disclosure. As used herein, amino lipid also includes its pharmaceutically acceptable salts, and its diastereomeric, enantiomeric, and epimeric forms.

In some embodiments, an amino lipid described herein, possesses one or more stereocenters and each stereocenter exists independently in either the R or S configuration. The lipids presented herein include all diastereomeric, enantiomeric, and epimeric forms as well as the appropriate mixtures thereof. The lipids provided herein include all cis, trans, syn, anti, entgegen (E), and zusammen (Z) isomers as well as the appropriate mixtures thereof. Tn certain embodiments, lipids described herein are prepared as their individual stereoisomers by reacting a racemic mixture of the compound with an optically active resolving agent to form a pair of diastereoisomeric compounds/salts, separating the diastereomers and recovering the optically pure enantiomers. In some embodiments, resolution of enantiomers is carried out using covalent diastereomeric derivatives of the compounds described herein. In another embodiment, diastereomers are separated by separation/resolution techniques based upon differences in solubility. In other embodiments, separation of stereoisomers is performed by chromatography or by the forming diastereomeric salts and separation by recrystallization, or chromatography, or any combination thereof. Jean Jacques, Andre Collet, Samuel H. Wilen, "Enantiomers, Racemates and Resolutions", John Wiley and Sons, Inc., 1981. In one aspect, stereoisomers are obtained by stereoselective synthesis.

In some embodiments, the lipids such as the amino lipids are substituted based on the structures disclosed herein. In some embodiments, the lipids such as the amino lipids are unsubstituted. In another embodiment, the lipids described herein are labeled isotopically (e.g. with a radioisotope) or by another other means, including, but not limited to, the use of chromophores or fluorescent moieties, bioluminescent labels, or chemiluminescent labels.

Lipids described herein include isotopically-labeled compounds, which are identical to those recited in the various formulae and structures presented herein, but for the fact that one or more atoms are replaced by an atom having an atomic mass or mass number different from the atomic mass or mass number usually found in nature. Examples of isotopes that can be incorporated into the present lipids include isotopes of hydrogen, carbon, nitrogen, oxygen, sulfur, fluorine and chlorine, such as, for example, $^{2}H$, $^{3}H$, $^{13}C$, $^{14}C$, $^{15}N$, $^{18}O$, $^{17}O$, $^{35}S$, $^{18}F$, $^{36}Cl$. In one aspect, isotopically-labeled lipids described herein, for example those into which radioactive isotopes such as $^{3}H$ and $^{14}C$ are incorporated, are useful in drug and/or substrate tissue distribution assays. In one aspect, substitution with isotopes such as deuterium affords certain therapeutic advantages resulting from greater metabolic stability, such as, for example, increased in vivo half-life or reduced dosage requirements.

In some embodiments, the asymmetric carbon atom of the amino lipid is present in enantiomerically enriched form. In certain embodiments, the asymmetric carbon atom of the amino lipid has at least 50% enantiomeric excess, at least 60% enantiomeric excess, at least 70% enantiomeric excess, at least 80% enantiomeric excess, at least 90% enantiomeric excess, at least 95% enantiomeric excess, or at least 99% enantiomeric excess in the (S)- or (R)-configuration.

In some embodiments, the disclosed amino lipids can be converted to N-oxides. In some embodiments, N-oxides are formed by a treatment with an oxidizing agent (e.g., 3-chloroperoxybenzoic acid and/or hydrogen peroxides). Accordingly, disclosed herein are N-oxide compounds of the described amino lipids, when allowed by valency and structure, which can be designated as N O or $N^{+}$—$O^{-}$. In some embodiments, the nitrogen in the compounds of the disclosure can be converted to N-hydroxy or N-alkoxy. For example, N-hydroxy compounds can be prepared by oxidation of the parent amine by an oxidizing agent such as ra-CPBA. All shown and claimed nitrogen containing compounds are also considered. Accordingly, also disclosed herein are N-hydroxy and NaI koxy (e.g., N—OR, wherein R is substituted or unsubstituted $C_1$-$C_6$ alkyl, $C_1$-$C_6$ alkenyl, $C_1$-$C_6$ alkynyl, 3-14-membered carbocycle or 3-14-membered heterocycle) derivatives of the described amino lipids.

PEG-Lipid

As used herein, a "PEG lipid" or "PEG-lipid" refers to a lipid comprising a polyethylene glycol component.

In some embodiments, the described LNP composition comprises a PEG-lipid. In some embodiments, the described LNP composition comprises two or more PEG-lipids. Exemplary PEG-lipids include, but are not limited to, the lipids. Exemplary PEG-lipids also include, but are not limited to, PEG-modified phosphatidylethanolamines, PEG-modified phosphatidic acids, PEG-modified ceramides, PEG-modified dialkylamines, PEG-modified diacylglycerols, PEG-modified dialkylglycerols, and mixtures thereof. For example, the one or more PEG-lipids can comprise PEG-c-DOMG, PEG-DMG, PEG-DLPE, PEG-DMPE, PEG-DPPC, a PEG-DSPE lipid, or a combination thereof. In some embodiments, PEG moiety is an optionally substituted linear or branched polymer of ethylene glycol or ethylene oxide. In some embodiments, the PEG moiety is substituted, e.g., by one or more alkyl, alkoxy, acyl, hydroxy, or aryl groups. In some embodiments, the PEG moiety includes PEG copolymer such as PEG-polyurethane or PEG-polypropylene (see, e.g., j. Milton Harris, Poly(ethylene glycol) chemistry: biotechnical and biomedical applications (1992)). In some embodiments, the PEG moiety does not include PEG copolymers, e.g., it may be a PEG monopolymer. Exemplary PEG-lipids include, but are not limited to, PEG-dilauroylglycerol, PEG-dimyristoylglycerol (PEG-DMG), PEG-dipalmitoylglycerol, PEG-distearoylgiycerol (PEG-DSPE), PEG-dipalmitoylglycerol, PEG-disteiylglycerol, PEG-dilawylglycamide, PEG-dimyristylglycamide, PEG-dipalmitoylglycamide, PEG-disterylglycamide, PEG-cholesterol, and PEG-DMB (3,4-Ditetradecoxylbenzyl-[omega]-methyl-poly(ethylene glycol) ether), 1,2-dimyristoyl-sn-glycero-3-phosphoethanolamine-N-[methoxy (polyethylene glycol)-2000]).

In some embodiments, a PEG-lipid is a PEG-lipid conjugate, for example, PEG coupled to dialkyloxypropyls (e.g., PEG-DAA conjugates), PEG coupled to diacylglycerols (e.g., PEG-DAG conjugates), PEG coupled to cholesterol, PEG coupled to phosphatidylethanolamines, and PEG conjugated to ceramides (see, e.g., U.S. Pat. No. 5,885,613), cationic PEG lipids, polyoxazoline (POZ)-lipid conjugates (e.g. POZ-DAA conjugates; see, e.g., WO 2010/006282), polyamide oligomers (e.g., ATTA-lipid conjugates), and mixtures thereof.

A PEG-lipid can comprise one or more ethylene glycol units, for example, at least 1, at least 2, at least 5, at least 10, at least 20, at least 30, at least 40, at least 50, at least 60, at least 70, at least 80, at least 90, at least 100, at least 120, or at least 150 ethylene glycol units.

In some embodiments, a number average molecular weight of the PEG-lipids is from about 200 Da to about 5000 Da. In some embodiments, a number average molecular weight of the PEG-lipids is from about 500 Da to about 3000 Da. In some embodiments, a number average molecular weight of the PEG-lipids is from about 750 Da to about 2500 Da. In some embodiments, a number average molecular weight of the PEG-lipids is from about 750 Da to about 2500 Da. In some embodiments, a number average molecular weight of the PEG-lipids is about 500 Da, about 750 Da, about 1000 Da, about 1250 Da, about 1500 Da, about 1750

Da, or about 2000 Da. In some embodiments, a polydispersity index (PD1) of the one or more PEG-lipids is smaller than 2. In some embodiments, a PDI of the one or more PEG-lipids is at most 1.1, 1.2, 1.3, 1.4, 1.5, 1.6, 1.7, 1.8, 1.9, 2.0, 2.1, 2.2, 2.3, 2.4, 2.5, 2.6, 2.7, 2.8, 2.9, or 3.0. In some embodiments, a PDI of the one or more PEG-lipids is at least 1.1, 1.2, 1.3, 1.4, 1.5, 1.6, 1.7, 1.8, 1.9, 2.0, 2.1, 2.2, 2.3, 2.4, 2.5, 2.6, 2.7, 2.8, 2.9, or 3.0.

In some embodiments, the PEG-lipid comprises from about 0.1 mol % to about 10 mol % of the total lipid present in the particle. In some embodiments, the PEG-lipid comprises from about 0.1 mol % to about 6 mol % of the total lipid present in the particle. In some embodiments, the PEG-lipid comprises from about 0.5 mol % to about 5 mol % of the total lipid present in the particle. In some embodiments, the PEG-lipid comprises from about 1 mol % to about 3 mol % of the total lipid present in the particle. In some embodiments, the PEG-lipid comprises about 2.0 mol % to about 2.5 mol % of the total lipid present in the particle. In some embodiments, the PEG-lipid comprises about 1 mol %, about 1.1 mol %, about 1.2 mol %, about 1.3 mol %, about 1.4 mol %, about 1.5 mol %, about 1.6 mol %, about 1.7 mol %, about 1.8 mol %, about 1.9 mol %, about 2.0 mol %, about 2.1 mol %, about 2.2 mol %, about 2.3 mol %, about 2.4 mol %, about 2.5 mol %, about 2.6 mol %, about 2.7 mol %, about 2.8 mol %, about 2.9 mol %, or about 3.0 mol % of the total lipid present in the particle.

In some embodiments, the LNP composition comprises a plurality of PEG-lipids, for example, at least 2, 3, 4, 5, 6, 7, 8, 9, 10, or more distinct PEG-lipids.

Phospholipid

As used herein, a "phospholipid" refers to a lipid that includes a phosphate moiety and one or more carbon chains, such as unsaturated fatty acid chains. A phospholipid may include one or more multiple (e.g., double or triple) bonds. In some embodiments, a phospholipid may facilitate fusion to a membrane. For example, a cationic phospholipid may interact with one or more negatively charged phospholipids of a membrane (e.g., a cellular or intracellular membrane). Fusion of a phospholipid to a membrane may allow one or more elements of an LNP to pass through the membrane, i.e., delivery of the one or more elements to a cell.

In some embodiments, the described LNP composition comprises a phospholipid. In some embodiments, the phospholipid comprises a lipid selected from the group consisting of: phosphatidylcholine (PC), phosphatidylethanolamine amine, glycerophospholipid, sphingophospholipids, Guriserohosuhono, sphingolipids phosphono lipids, natural lecithins, and hydrogenated phospholipid. In some embodiments, the phospholipid comprises a phosphatidylcholine. Exemplary phosphatidylcholines include, but are not limited to, soybean phosphatidylcholine, egg yolk phosphatidylcholine (EPC), distearoylphosphatidylcholine, 1,2-distearoyl-sn-glycero-3-phosphocholine (DSPC), dipalmitoyl phosphatidylcholine, dipalmitoyl-sn-glycero-3-phosphocholine (DPPC), 2-Oleoyl-1-palmitoyl-sn-glycero-3-phosphocholine (POPC), dimyristoyl phosphatidylcholine (DMPC), and dioleoyl phosphatidylcholine (DOPC). In certain specific embodiments, the phospholipid is DSPC.

In some embodiments, the phospholipid comprises a phosphatidylethanolamine amine. In some embodiments, the phosphatidylethanolamine amine is distearoyl phosphatidylethanolamine (DSPE), dipalmitoyl phosphatidyl ethanolamine (DPPE), 1,2-dioleoyl-sn-glycero-3-phosphoethanolamine (DOPE), dimyristoyl phosphoethanolamine (DMPE), 16-0-Monome Le PE, 16-0-dimethyl PE, 18-1-trans PE, palmitoyl oleoyl-phosphatidylethanolamine (POPE), or 1-stearoyl-2-oleoyl-phosphatidyl ethanolamine (SOPE). In some embodiments, the phospholipid comprises a glycerophospholipid. In some embodiments, the glycerophospholipid is plasmalogen, phosphatidate, or phosphatidylcholine. In some embodiments, the glycerophospholipid is phosphatidylserine, phosphatidic acid, phosphatidylglycerol, phosphatidylinositol, palmitoyl oleoyl phosphatidylglycerol (POPG), or lysophosphatidylcholine. In some embodiments, the phospholipid comprises a sphingophospholipid. In some embodiments, the sphingophospholipid is sphingomyelin, ceramide phosphoethanolamine, ceramide phosphoglycerol, or ceramide phosphoglycerophosphoric acid. In some embodiments, the phospholipid comprises a natural lecithin. In some embodiments, the natural lecithin is egg yolk lecithin or soybean lecithin. Tn some embodiments, the phospholipid comprises a hydrogenated phospholipid. In some embodiments, the hydrogenated phospholipid is hydrogenated soybean phosphatidylcholine. In some embodiments, the phospholipid is selected from the group consisting of: phosphatidylcholine, phosphatidylethanolamine, phosphatidylserine, phosphatidylinositol, phosphatidic acid, palmitoyloleoyl phosphatidylcholine, lysophosphatidylcholine, lysophosphatidylethanolamine, dipalmitoylphosphatidylcholine, dioleoylphosphatidylcholine, distearoylphosphatidylcholine, and dilinoleoylphosphatidylcholine.

In some embodiments, the phospholipid comprises a lipid selected from: 1,2-distearoyl-sn-glycero-3-phosphocholine (DSPC). 1,2-dioleoyl-sn-glycero-3-phosphoethanolamine (DOPE), 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-diundecanoyl-sn-glycero-phosphocholine (DUPC), 2-Oleoyl-1-pahnitoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-di arachidonoyl-sn-glycero-3-phosphocholine, 1,2-di docosahexaenoyl-sn-glycero-3-phosphocholine, 1,2-diphytanoyl-sn-glycero-3-phosphoethanolamine (ME 16.0 PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diaracliidonoyl-sn-glycero-3-phosphoethanol amine, 1,2-di docosahexaenoyl-sn-glycero-3-phosphoethanolamine, 1,2-diol eoy I-sn-glycero-3-phospho-rac-(1-glycerol) sodium salt (DOPG), and sphingomyelin.

A phospholipid can comprise a phospholipid moiety and one or more fatty acid moieties. A phospholipid moiety can comprise phosphatidyl choline, phosphatidyl ethanolamine, phosphatidyl glycerol, phosphatidyl serine, phosphatidic acid, 2-lysophosphatidyl choline, or a sphingomyelin. A fatty acid moiety can comprise lauric acid, myristic acid, myristoleic acid, palmitic acid, palmitoleic acid, stearic acid, oleic acid, linoleic acid, alpha-linolenic acid, erucic acid, phytanoic acid, arachidic acid, arachidonic acid, eicosapentaenoic acid, behenic acid, docosapentaenoic acid, or docosahexaenoic acid. In some specific embodiments, a phospholipid can be functionalized with or cross-linked to one or more alkynes, which may undergo a copper-catalyzed cycloaddition upon exposure to an azide.

In some embodiments, the LNP composition comprises a plurality of phospholipids, for example, at least 2, 3, 4, 5, or more distinct phospholipids. In some embodiments, the phospholipid comprises from 1 mol % to 20 mol % of the total lipid present in the particle. In some embodiments, the phospholipid comprises from about 5 mol % to about 15 mol % of the total lipid present in the particle. In some embodiments, the phospholipid comprises from about 8 mol % to about 12 mol % of the total lipid present in the particle. In some embodiments, the phospholipid comprises from about 9 mol %, 10 mol %, or 11 mol % of the total lipid present in the particle.

Cholesterol

In some embodiments, the LNP composition comprises a cholesterol or a derivative thereof. In some embodiments, the LNP composition comprises a structural lipid. The structural lipid can be selected from steroid, sterol, alkyl resoreinol, cholesterol or derivative thereof, fecosterol, sitosterol, ergosterol, campesterol, stigmasterol, brassicasterol, tomatidine, tomatine, ursolic acid, alphatocopherol, and a combination thereof. In some embodiments, the structural lipid is a corticosteroid such as prednisolone, dexamethasone, prednisone, and hydrocortisone. In some embodiments, the cholesterol or derivative thereof is cholesterol, 5-heptadecylresorcinol, or cholesterol hemisuccinate. Tn some embodiments, the cholesterol or derivative thereof is cholesterol.

In some embodiments, the cholesterol or derivative thereof is a cholesterol derivative. In some embodiments, the cholesterol derivative is a polar cholesterol analogue. In some embodiments, the polar cholesterol analogue is 5a-cholestanol, 513-coprostanol, cholesteryl-(2'-hydroxy)-ethyl ether, cholestely 1-(4'-hydroxy)-butyl ether, or 6-ketocholestanol. In some embodiments, the polar cholesterol analogue is cholesteryl-(4'-hydroxy)-butyl ether. In some embodiments, the cholesterol derivative is a non-polar cholesterol analogue. In some embodiments, the non-polar cholesterol analogue is 5acholestane, cholestenone, 5a-cholestanone, 50-cholestanone, or cholestetyl decanoate.

In some embodiments, the cholesterol or the derivative thereof comprises from 20 mol % to 50 mol % of the total lipid present in the particle. In some embodiments, the cholesterol or the derivative thereof comprises about 20 mol %, about 21 mol %, about 22 mol %, about 23 mol %, about 24 mol %, about 25 mol %, about 26 mol %, about 27 mol %, about 28 mol %, about 29 mol %, about 30 mol %, about 31 mol %, about 32 mol %, about 33 mol %, about 34 mol %, about 35 mol %, about 36 mol %, about 37 mol %, about 38 mol %, about 39 mol %, about 40 mol %, about 41 mol %, about 42 mol %, about 43 mol %, about 44 mol %. about 45 mol %. about 46 mol %, about 47 mol %, about 48 mol %, or about 50 mol % of the total lipid present in the particle.

Phosphate Charge Neutralizer

In some embodiments, the LNP described herein comprises a phosphate charge neutralizer. In some embodiments, the phosphate charge neutralizer comprises arginine, asparagine, glutamine, lysine, histidine, cationic dendrimers, polyamines, or a combination thereof. In some embodiments, the phosphate charge neutralizer comprises one or more nitrogen atoms. In some embodiments, the phosphate charge neutralizer comprises a polyamine. In some embodiments, the polyamine is 1,3-propanediamine, spermine, spermidine, Norspermidine, Tris(2-aminoethyDamine, Cyclen, 1,4,7-Triazacyclononane, 1,1,1-Tris(aminomethyl) ethane, Diethylenetriamine, Triethylenetetramine, or a combination thereof. In some embodiments, the polyamine is 1,3-propanediamine, 1,4-butanediamine, spermine, spermidine, or a combination thereof. In some embodiments, the N/P ratio for the phosphate charge neutralizer is from 0.01 to 10. In some embodiments, the N/P ratio for the phosphate charge neutralizer is from about 0.05 to about 2. In some embodiments, the N/P ratio for the phosphate charge neutralizer is from about 0.1 to about 1. In some embodiments, the N/P ratio for the phosphate charge neutralizer is about 0.1, about 0.2, about 0.3, about 0.4, about 0.5, about 0.6, about 0.7, about 0.8, about 0.9, or about 1. In some embodiments, the NIP ratio for the phosphate charge neutralizer is about 0.25, 0.5, or 0.75.

Antioxidants

In some embodiments, the LNP described herein comprises one or more antioxidants. In some embodiments, the one or more antioxidants function to reduce a degradation of the cationic lipids, the payload, or both. In some embodiments, the one or more antioxidants comprise a hydrophilic antioxidant. In some embodiments, the one or more antioxidants is a chelating agent such as ethylenediaminetetraacefic acid (EDTA) and citrate. In some embodiments, the one or more antioxidants is EDTA. In some embodiments, the one or more antioxidants comprise a lipophilic antioxidant. In some embodiments, the lipophilic antioxidant comprises a vitamin E isomer or a polyphenol. In some embodiments, the one or more antioxidants are present in the LNP composition at a concentration of at least 1 mM, at least 10 mM, at least 20 mM, at least 50 mM, or at least 100 mM. In some embodiments, the one or more antioxidants are present in the particle at a concentration of about 20 mM.

Payload

The LNPs described herein can be designed to deliver a payload, such as a therapeutic agent, or a target of interest. In some embodiments, an LNP described herein encloses one or more components of a base editor system as described herein. For example, a LNP may enclose one or more of a guide RNA, a nucleic acid encoding the guide RNA, a vector encoding the guide RNA, a base editor fusion protein, a nucleic acid encoding the base editor fusion protein, a programmable DNA binding domain, a nucleic acid encoding the programmable DNA binding domain, a deaminase, a nucleic acid encoding the deaminase, or all or any combination thereof. In some embodiments, the nucleic acid is a DNA. In some embodiments, the nucleic acid is a RNA, for example, a mRNA.

Additional exemplary therapeutic agents include, but are not limited to, antibodies (e.g., monoclonal, chimeric, humanized, nanobodies, and fragments thereof etc.), cholesterol, hormones, peptides, proteins, chemotherapeutics and other types of antineoplastic agents, low molecular weight drugs, vitamins, co-factors, nucleosides, nucleotides, oligonucleotides, enzymatic nucleic acids, antisense nucleic acids, triplex forming oligonucleotides, antisense DNA or RNA compositions, chimeric DNA:RNA compositions, allozymes, aptamers, ribozyme, decoys and analogs thereof, plasmids and other types of expression vectors, and small nucleic acid molecules, RNAi agents, short interfering nucleic acid (siNA), messenger ribonucleic acid (messenger RNA, mRNA), short interfering RNA (siRNA), double-stranded RNA (dsRNA), micro-RNA (miRNA), and short hairpin RNA (shRNA) molecules, peptide nucleic acid (PNA), a locked nucleic acid ribonucleotide (LNA), morpholino nucleotide, threose nucleic acid (TNA), glycol nucleic acid (GNA), sisiRNA (small internally segmented interfering RNA), aiRNA (asymetrical interfering RNA), and siRNA with 1, 2 or more mismatches between the sense and anti-sense strand to relevant cells and/or tissues, such as in a cell culture, subject or organism. Therapeutic agents can be purified or partially purified, and can be naturally occurring or synthetic, or chemically modified. In some embodiments, the therapeutic agent is an RNAi agent, short interfering nucleic acid (siNA), short interfering RNA (siRNA), double-stranded RNA (dsRNA), micro-RNA (miRNA), or a short hairpin RNA (shRNA) molecule. In some embodiments, the therapeutic agent is an mRNA.

In some embodiments, the payload comprises one or more nucleic acid(s) (i.e., one or more nucleic acid molecular entities). In some embodiments, the nucleic acid is a single-stranded nucleic acid. In some embodiments, single-stranded nucleic acid is a DNA. In some embodiments, single-stranded nucleic acid is an RNA. In some embodiments, the nucleic acid is a double-stranded nucleic acid. In some embodiments, the double-stranded nucleic acid is a DNA. In some embodiments, the double-stranded nucleic acid is an RNA. In some embodiments, the double-stranded nucleic acid is a DNA-RNA hybrid. In some embodiments, the nucleic acid is a messenger RNA (mRNA), a microRNA, an asymmetrical interfering RNA (aiRNA), a small hairpin RNA (shRNA), or a Dicer-Substrate dsRNA.

Other Lipids

In some embodiments, the disclosed LNP compositions comprise a helper lipid. In some embodiments, the disclosed LNP compositions comprise a neutral lipid. In some embodiments, the disclosed LNP compositions comprise a stealth lipid. In some embodiments, the disclosed LNP compositions comprises additional lipids.

As used herein, neutral lipids suitable for use in a lipid composition of the disclosure include, for example, a variety of neutral, uncharged or zwitterionic lipids. Examples of neutral phospholipids suitable for use in the present disclosure include, but are not limited to, 5-heptadecylbenzene-1, 3-diol (resorcinol), 1,2-dipalmitoyl-sn-glycero-3-phosphocholine (DPPC), 1,2-distearoyl-sn-glycero-3-phosphocholine (DSPC), phosphocholine (DOPC), 1,2-dimyristoyl-sn-glycero-phosphocholine (DMPC), phosphatidylcholine (PLPC), 1,2-distearoyl-sn-glycero-3-phosphocholine (DAPC), phosphatidylethanolamine (PE), egg phosphatidylcholine (EPC), dilauryloylphosphatidylcholine (DLPC), 1-myristoyl-2-palmitoyl phosphatidylcholine (MPPC), 1-palmitoyl-2-myristoyl phosphatidylcholine (PMPC), 1-palmitoyl-2-stearoyl phosphatidylcholine (PSPC), 1,2-diarachidoylsn-glycero-3-phosphocholine (DBPC), 1-stearoyl-2-palmitoyl phosphatidylcholine (SPPC), 1,2-dieicosenoyl-sn-glycero-3-phosphocholine (DEPC), 2-Oleoyl-1-palmitoyl-sn-glycero-3-phosphocholine (POPC), lysophosphatidyl choline, 1,2-dioleoyl-sn-glycero-3-phosphoethanolamine (DOPE), dilinoleoylphosphatidylcholine distearoylphosphatidylethanolamine (DSPE), dimyristoyl phosphatidylethanolamine (DMPE), dipalmitoyl phosphatidylethanolamine (DPPE), palmitoyloleoyl phosphatidylethanolamine (POPE), lysophosphatidylethanolamine and combinations thereof.

In some embodiments, the neutral phospholipid is selected from the group consisting of DSPC and dimyristoyl phosphatidyl ethanolamine (DMPE). In some embodiments, the neutral phospholipid is DSPC. Neutral lipids can function to stabilize and improve processing of the LNPs.

Helper lipids can refer to lipids that enhance transfection (e.g. transfection of the nanoparticle (LNP) comprising the composition as provided herein, including the biologically active agent). The mechanism by which the helper lipid enhances transfection includes enhancing particle stability. In some embodiments, the helper lipid enhances membrane fusogenicity. Helper lipids can include steroids, sterols, and alkyl resorcinols. Helper lipids suitable for use in the present disclosure can include, but are not limited to, cholesterol, 5-heptadecylresorcinol, and cholesterol hemisuccinate. In some embodiments, the helper lipid is cholesterol. In some embodiments, the helper lipid is be cholesterol hemisuccinate.

Stealth lipids can refer to lipids that alter the length of time the nanoparticles can exist in vivo (e.g., in the blood). Stealth lipids can assist in the formulation process by, for example, reducing particle aggregation and controlling particle size. Stealth lipids used herein may modulate pharmacokinetic properties of the LNP. Stealth lipids suitable for use in a lipid composition of the disclosure can include, but are not limited to, stealth lipids having a hydrophilic head group linked to a lipid moiety. Stealth lipids suitable for use in a lipid composition of the present disclosure and information about the biochemistry of such lipids can be found in Romberg et al, Pharmaceutical Research, Vol. 25, No. 1, 2008, pg. 55-71 and I-Toekstra et al, Biochimica et Biophysica Acta 1660 (2004) 41-52. Additional suitable PEG lipids are disclosed, e.g., in WO 2006/007712.

In some embodiments, the stealth lipid is a PEG-lipid. In one embodiment, the hydrophilic head group of stealth lipid comprises a polymer moiety selected from polymers based on PEG (sometimes referred to as poly(ethylene oxide)), poly(oxazoline), poly(vinyl alcohol), poly(glycerol), poly (N-vinylpyrrolidone), polyaminoacids and poly N-(2-hydroxypropyl)methacrylamide]. Stealth lipids can comprise a lipid moiety. In some embodiments, the lipid moiety of the stealth lipid may be derived from diacylglycerol or diacylglycamide, including those comprising a dialkylglycerol or dialkylglycamide group having alkyl chain length independently comprising from about C4 to about C40 saturated or unsaturated carbon atoms, wherein the chain may comprise one or more functional groups such as, for example, an amide or ester. The dialkylglycerol or dialkylglycamide group can further comprise one or more substituted alkyl groups.

The structures and properties of helper lipids, neutral lipids, stealth lipids, and/or other lipids are further described in WO2017173054A1, WO2019067999A1, US20180290965A1, US20180147298A1, US20160375134A1, U.S. Pat. Nos. 8,236,770, 8,021,686, 8,236,770B2, U.S. Pat. No. 7,371,404B2, U.S. Pat. No. 7,780,983B2, U.S. Pat. No. 7,858,117B2, US20180200186A1, US20070087045A1, WO2018119514A1, and WO2019067992A1, all of which are hereby incorporated by reference in their entirety.

LNP Formulations

The LNPs described herein can be designed for one or more specific applications or targets. The elements of a nanoparticle (LNP) composition or a composition can be selected based on a particular application or target, and/or based on the efficacy, toxicity, expense, ease of use, and availability. Similarly, the particular formulation of a nanoparticle composition is a composition comprising one or more described lipids. may be selected for the particular application or target. Suitable phosphate charge neutralizers to be used in formulations include, but are not limited to, Spermidine and 1,3-propanediamine.

The described LNP formulations can be designed for one or more specific applications or targets. For example, a nanoparticle composition may be designed to deliver a therapeutic agent such as an RNA to a particular cell, tissue, organ, or system or group thereof in a mammal's body. Physiochemical properties of nanoparticle compositions may be altered in order to increase selectivity for particular bodily targets. For instance, particle sizes may be adjusted based on the fenestration sizes of different organs. The therapeutic agent included in a nanoparticle composition may also be selected based on the desired delivery target or targets. For example, a therapeutic agent may be selected for a particular indication, condition, disease, or disorder and/or for delivery to a particular cell, tissue, organ, or system or group thereof (e.g., localized or specific delivery). In certain embodiments, a nanoparticle composition may include an mRNA encoding a polypeptide of interest capable of being translated within a cell to produce the polypeptide of interest. Such a composition may be designed to be specifically delivered to a particular organ.

The amount of a therapeutic agent in an LNP composition may depend on the size, composition, desired target and/or application, or other properties of the nanoparticle composition. For example, the amount of an RNA comprised in a nanoparticle composition may depend on the size, sequence, and other characteristics of the RNA. The relative amounts of a therapeutic agent and other elements (e.g., lipids) in a nanoparticle composition may also vary. In some embodiments, the wt/wt ratio of the lipid component to a therapeutic agent in a nanoparticle composition may be from about 5:1 to about 60:1, such as about 5:1, 6:1, 7:1, 8:1, 9:1, 10:1, 11:1, 12:1, 13:1, 14:1, 15:1, 16:1, 17:1, 18:1, 19:1, 20:1, 25:1, 30:1, 35:1, 40:1, 45:1, 50:1, and 60:1. For example, the wt/wt ratio of the lipid component to a therapeutic agent may be from about 10:1 to about 40:1. In certain embodiments, the wt/wt ratio is about 20:1. The amount of a therapeutic agent in a nanoparticle composition can be measured using absorption spectroscopy (e.g., ultraviolet-visible spectroscopy).

In some embodiments, an LNP composition comprises one or more nucleic acids such as RNAs. In some embodiments, the one or more RNAs, lipids, and amounts thereof may be selected to provide a specific NIP ratio. The NIP ratio can be selected from about 1 to about 30. The N/P ratio can be selected from about 2 to about 10. In some embodiments, the NIP ratio is from about 0.1 to about 50. In some embodiments, the N/P ratio is from about 2 to about 8. hi some embodiments, the NIP ratio is from about 2 to about 15, from about 2 to about 10, from about 2 to about 8, from about 2 to about 6, from about 3 to about 15, from about 3 to about 10, from about 3 to about 8, from about 3 to about 6, from about 4 to about 15, from about 4 to about 10, from about 4 to about 8, or from about 4 to about 6. hi some embodiments, the N/P ratio is about 2, about 2.5, about 3, about 3.5, about 4, about 4.5, about 5, about 5.5, about 6, or about 6.5. In some embodiments, the NIP ratio is from about 4 to about 6. In some embodiments, the NIP ratio is about 4, about 4.5, about 5, about 5.5, or about 6.

In some embodiments, the LNPs are formed with an average encapsulation efficiency ranging from about 50% to about 70%, from about 70% to about 90%, or from about 90% to about 100%. In some embodiments, the LNPs are formed with an average encapsulation efficiency ranging from about 75% to about 95%.

In another aspect, provided herein is a lipid nanoparticle (LNP) comprising the composition as provided herein. As used herein, a lipid nanoparticle (LNP) composition or a nanoparticle composition is a composition comprising one or more described lipids. LNP compositions are typically sized on the order of micrometers or smaller and may include a lipid bilayer. Nanoparticle compositions encompass lipid nanoparticles (LNPs), liposomes (e.g., lipid vesicles), and lipoplexes. In some embodiments, a LNP refers to any particle that has a diameter of less than 1000 nm, 500 nm, 250 nm, 200 nm, 150 nm, 100 nm, 75 nm, 50 nm, or 25 nm. In some embodiments, a nanoparticle may range in size from 1-1000 nm, 1-500 nm, 1-250 nm, 25-200 nm, 25-100 nm, 35-75 nm, or 25-60 nm. In some embodiments, a liposome having a lipid bilayer with a diameter of 500 nm or less. In some embodiments, the LNPs described herein can have a mean diameter of from about 1 nm to about 2500 nm, from about 10 nm to about 1500 nm, from about 20 nm to about 1000 nm, from about 30 nm to about 150 nm, from about 40 nm to about 150 nm, from about 50 nm to about 150 nm, from about 60 nm to about 130 nm, from about 70 nm to about 110 nm, from about 70 nm to about 100 nm, from about 80 nm to about 100 nm, from about 90 nm to about 100 nm, from about 70 to about 90 nm, from about 80 nm to about 90 nm- or from about 70 nm to about 80 nm. The LNPs described herein can have a mean diameter of about 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, 150 nm, or greater. The LNPs described herein can be substantially non-toxic.

In some embodiments, an LNP may be made from cationic, anionic, or neutral lipids. In some embodiments, an LNP may comprise neutral lipids, such as the fusogenic phospholipid 1,2-Dioleoyl-sn-glycero-3-phosphoethanolamine (DOPE) or the membrane component cholesterol, as helper lipids to enhance transfection activity and nanoparticle stability. In some embodiments, an LNP may comprise hydrophobic lipids, hydrophilic lipids, or both hydrophobic and hydrophilic lipids. Any lipid or combination of lipids that are known in the art can be used to produce an LNP. Examples of lipids used to produce LNPs include, but are not limited to DOTMA (N[1-(2,3-dioleyloxy)propyl]-N,N,N-trimethylammonium chloride), DOSPA (N,N-dimethyl-N-([2-sperminecarboxamido]ethyl)-2,3-bis(dioleyloxy)-1-propaniminium pentahydrochloride), DOTAP (1,2-Dioleoyl-3-trimethylammonium propane), DMRIE (N-(2-hydroxyethyl)-N,N-dimethyl-2,3-bis(tetradecyloxy-1-propanaminiumbromide), DC-cholesterol (3βP—[N—(N', N'-dimethylaminoethane)-carbamoyl]cholesterol), DOTAP-cholesterol, GAP-DMORIE-DPyPE, and GL67A-DOPE-DMPE (2-Bis(dimethylphosphino)ethane)-polyethylene glycol (PEG). Examples of cationic lipids include, but are not limited to, 98N12-5, $C_{12}$-200, DLin-KC2-DMA (KC2), DLin-MC3-DMA (MC3), XTC, MD1, and $7C_1$. Examples of neutral lipids include, but are not limited to, DPSC, DPPC (Dipalmitoylphosphatidylcholine), POPC (1-palmitoyl-2-oleoyl-sn-glycero-3-phosphocholine), DOPE, and SM (sphingomyelin). Examples of PEG-modified lipids include, but are not limited to, PEG-DMG (Dimyristoyl glycerol), PEG-CerC14, and PEG-CerC20. In some embodiments, the lipids may be combined in any number of molar ratios to produce a LNP. In some embodiments, the polynucleotide may be combined with lipid(s) in a wide range of molar ratios to produce an LNP.

The term "substituted", unless otherwise indicated, refers to the replacement of one or more hydrogen radicals in a given structure with the radical of a specified substituent including, but not limited to: halo, alkyl, alkenyl, alkynyl, aryl, heterocyclyl, thiol, alkylthio, oxo, thioxy, arylthio, alkylthioalkyl, arylthioallcyl, alkylsulfonyl, alkylsulfonylalkyl, arylsulfonylalkyl, alkoxy, aryloxy, aralkoxy, aminocarbonyl, alkylaminocarbonyl, aiylaminocarbonyl, alkoxycarbonyl, aryloxycarbonyl, haloalkyl, amino, trifluoromethyl, cyano, nitro, alkylamino, arylamino, alkylaminoalkyl, aiylaminoalkyl, aminoalkylamino, hydroxy, alkoxyalkyl, carboxyalkyl, alkoxycarbonylalkyl, aminocarbonylalkyl, acyl, aralkoxycarbonyl, carboxylic acid, sulfonic acid, sulfonyl, phosphonic acid, aryl, heteroaryl, heterocyclic, and an aliphatic group. It is understood that the substituent may be further substituted. Exemplary substituents include amino, alkylamino, and the like.

As used herein, the term "substituent" means positional variables on the atoms of a core molecule that are substituted at a designated atom position, replacing one or more hydrogens on the designated atom, provided that the designated atom's normal valency is not exceeded, and that the substitution results in a stable compound. Combinations of substituents and/or variables are permissible only if such combinations result in stable compounds. A person of ordinal), skill in the art should note that any carbon as well as heteroatom with valences that appear to be unsatisfied as described or shown herein is assumed to have a sufficient number of hydrogen atom(s) to satisfy the valences described or shown. In certain instances one or more substituents having a double bond (e.g., "oxo" or "=O") as the point of attachment may be described, shown or listed herein within a substituent group, wherein the structure may only show a single bond as the point of attachment to the core structure of Formula (I). A person of ordinary skill in the art would understand that, while only a single bond is shown, a double bond is intended for those substituents.

The term "alkyl" refers to a straight or branched hydrocarbon chain radical, having from one to twenty carbon atoms, and which is attached to the rest of the molecule by a single bond. An alkyl comprising up to 10 carbon atoms is referred to as a $C_1$-$C_{10}$ alkyl, likewise, for example, an alkyl comprising up to 6 carbon atoms is a $C_1$-$C_6$ alkyl. Alkyls (and other moieties defined herein) comprising other numbers of carbon atoms are represented similarly. Alkyl groups include, but are not limited to, $C_1$-$C_{10}$ alkyl, $C_1$-$C_9$ alkyl, $C_1$-$C_8$ alkyl. $C_1$-$C_7$ alkyl, $C_1$-$C_6$ alkyl, $C_1$-$C_5$ alkyl, $C_1$-$C_4$ alkyl, $C_1$-$C_3$ alkyl, $C_1$-$C_2$ alkyl, $C_2$-$C_8$ alkyl, $C_3$-$C_8$ alkyl and $C_4$-$C_8$ alkyl. Representative alkyl groups include, but are not limited to, methyl, ethyl, n-propyl, 1-methylethyl (i-propyl), n-butyl, i-butyl, s-butyl, n-pentyl, 1,1-dimethylethyl (t-butyl), 3-methylhexyl, 2-methylhexyl, 1-ethyl-propyl, and the like. In some embodiments, the alkyl is methyl or ethyl. In some embodiments, the alkyl is —$CH(CH_3)_2$ or —$C(CH_3)_3$. Unless stated otherwise specifically in the specification, an alkyl group may be optionally substituted as described below. "Alkylene" or "alkylene chain" refers to a straight or branched divalent hydrocarbon chain linking the rest of the molecule to a radical group. In some embodiments, the alkylene is —Cl-12-, —$CH_2CH_2$—, or —$CH_2CH_2CH_2$—. In some embodiments, the alkylene is —$CH_2$—. In some embodiments, the alkylene is —$CH_2CH_2$—. In some embodiments, the alkylene is —$CH_2CH_2CH_2$—.

The term "alkenyl" refers to a type of alkyl group in which at least one carbon-carbon double bond is present. In one embodiment, an alkenyl group has the formula —C(R)=$CR^2$, wherein R refers to the remaining portions of the alkenyl group, which may be the same or different. In some embodiments, R is H or an alkyl. In some embodiments, an alkenyl is selected from ethenyl (i.e., vinyl), propenyl (i.e., allyl), butenyl, pentenyl, pentadienyl, and the like. Non-limiting examples of an alkenyl group include —$CH=CH_2$, —$C(CH_3)=CH_2$, —$CH=CHCH_3$, —$C(CH_3)=CHCH_3$, and —$CH_2CH=CH_2$.

The term "cycloalkyl" refers to a monocyclic or polycyclic non-aromatic radical, wherein each of the atoms forming the ring (i.e. skeletal atoms) is a carbon atom. In some embodiments, cycloalkyls are saturated or partially unsaturated. In some embodiments, cycloalkyls are spirocyclic or bridged compounds. In some embodiments, cycloalkyls are fused with an aromatic ring (in which case the cycloalkyl is bonded through a non-aromatic ring carbon atom). Cycloalkyl groups include groups having from 3 to 10 ring atoms. Representative cycloalkyls include, but are not limited to, cycloalkyls having from three to ten carbon atoms, from three to eight carbon atoms, from three to six carbon atoms, or from three to five carbon atoms. Monocyclic cycloalkyl radicals include, for example, cyclopropyl, cyclobutyl, cyclopentyl, cyclohexyl, cycloheptyl, and cyclooctyl. In some embodiments, the monocyclic cycloalkyl is cyclopropyl, cyclobutyl, cyclopentyl or cyclohexyl. In some embodiments, the monocyclic cycloalkyl is cyclopentenyl or cyclohexenyl. In some embodiments, the monocyclic cycloalkyl is cyclopenteny 1. Polycyclic radicals include, for example, adamantyl, 1,2-dihydronaphthalenyl, 1,4-dihydronaphthalenyl, tetrainyl, decalinyl, 3,4-dihydronaphthalenyl-.1 (2H)-one. spiro[2.2]pentyl, norbomyl and bicycle[1.1.1]pentyl. Unless otherwise stated specifically in the specification, a cycloalkyl group may be optionally substituted. Depending on the structure, a cycloalkyl group can be monovalent or divalent (i.e., a cycloalkylene group).

The term "heterocycle" or "heterocyclic" refers to heteroaromatic rings (also known as heteroaryls) and heterocycloallcyl rings (also known as heteroalicyclic groups) that includes at least one heteroatom selected from nitrogen, oxygen and sulfur, wherein each heterocyclic group has from 3 to 12 atoms in its ring system, and with the proviso that any ring does not contain two adjacent O or S atoms. A "heterocyclyl" is a univalent group formed by removing a hydrogen atom from any ring atoms of a heterocyclic compound. In some embodiments, heterocycles are monocyclic, bicyclic, polycyclic, spirocyclic or bridged compounds. Non-aromatic heterocyclic groups (also known as heterocycloalkyls) include rings having 3 to 12 atoms in its ring system and aromatic heterocyclic groups include rings having 5 to 12 atoms in its ring system. The heterocyclic groups include benzofused ring systems. Examples of non-aromatic heterocyclic groups are pyrrolidinyl, tetrahydrofuranyl, dihydrofuranyl, tetrahydrothienyl, oxazolidinonyl, tetrahydropyranyl, dihydropyranyl, tetrahydrothiopyranyl, piperidinyl, morpholinyl. thiomorpholinyl, thioxanyl, piperazinyl, aziridinyl, azetidinyl, oxetanyl, thietanyl, homopiperidinyl, oxepanyl, thiepanyl, oxazepinyl, diazepinyl, thiazepinyl, 1,2,3,6-tetrahydropyridinyl, pyrrolin-2-yl, pyrrolin-3-yl, indolinyl, 2H-pyranyl, 4Hpyranyl, dioxanyl, 1,3-dioxolanyl, pyrazolinyl, dithianyl, dithiolanyl, dihydropyranyl, dihydrothienyl, dihydrofuranyl, pyrazolidinyl, imidazolinyl, imidazoli diny I , 3-az.abicy cl o[3. 1.0]hexany 1,3-azabicyclo[4.1.0]heptanyl, 3 h-indolyl, indolin-2-onyl, isoindolin-1-onyl, isoindoline-1,3-dionyl, 3,4-dihydroisoquinolin-1(2H)-onyl, 3,4-dihydroquinolin-2 (1H)-onyl, isoindoline-1,3-dithionyl, benzo[d]oxazol-2 (3H)-onyl, 1H-benzo[d]imidazol-2(3H)-onyl, benzo[d]thiazol-2(3H)-onyl, and quinolizinyl. Examples of aromatic heterocyclic groups are pyridinyl, imidazolyl, pyrimidinyl, pyrazolyl, triazolyl, pyrazinyl, tetrazolyl, futyl, thienyl, isoxazolyl, thiazolyl, oxazolyl, isothiazolyl, pyrrolyl, quinolinyl, isoquinolinyl, indolyl, benzimidazolyl, benzofuranyl, cinnolinyl, indazolyl, indolizinyl, phthalazinyl, pyridazinyl, triazinyl, isoindolyl, pteridinyl, purinyl, oxadiazolyl, thiadiazolyl, furaz.anyl, benzofuraz.anyl, benzothiophenyl, benzothiazolyl, benzoxazolyl, quinazolinyl, quinoxalinyl, naphthyridinyl, and furopyridinyl. The foregoing groups are either C-attached (or Clinked) or N-attached where such is possible. For instance, a group derived from pyrrole includes both pyrrol-1-yl (N-attached) or pyrrol-3-yl (C-attached). Further, a group derived from imidazole includes imidazol- 1-yl or imidazol-3-yl (both N-attached) or imidazol-2-yl, imidazol-4-yl or imidazol-5-yl (all C-attached). The heterocyclic groups include benzo-fused ring systems. Non-aromatic heterocycles are optionally substituted with one or two oxo (=O) moieties, such as pyrrolidin-2-one. In some embodiments, at least one of the two rings of a bicyclic heterocycle is aromatic. In some embodiments, both rings of a bicyclic heterocycle are aromatic.

The term "heterocycloalkyl" refers to a cycloalkyl group that includes at least one heteroatom selected from nitrogen, oxygen, and sulfur. Unless stated otherwise specifically in the specification, the heterocycloalkyl radical may be a monocyclic, or bicyclic ring system, which may include fused (when fused with an aryl or a heterowyl ring, the heterocycloalkyl is bonded through a non-aromatic ring atom) or bridged ring systems. The nitrogen, carbon or sulfur atoms in the heterocyclyl radical may be optionally oxidized. The nitrogen atom may be optionally quaternized. The heterocycloalkyl radical is partially or fully saturated. Examples of heterocycloalkyl radicals include, but are not limited to, dioxolanyl, thienyl[1,3]dithianyl, tetrahydroquinolyl, tetrahydroisoquinolyl, decahydroquinolyl, decahydroisoquinolyl, imidazolinyl, imidazolidinyl, isothiazolidinyl, isoxazolidinyl, morpholinyl, octahydroindolyl, octahydroisoindolyl, 2-oxopiperazinyl, 2-oxopiperidinyl, 2-oxopyrrolidinyl, oxazolidinyl, piperidinyl, piperazinyl, 4-piperidonyl, pyrrolidinyl, pyrazolidinyl, quinuclidinyl, thiazolidinyl, tetrahydrofuryl, trithianyl, tetrahydropyranyl, thiomorpholinyl, thiamorpholinyl, 1-oxothiomorpholinyl, 1,1-dioxo-thiomorpholinyl. The term heterocycloalkyl also includes all ring forms of carbohydrates, including but not limited to monosaccharides, disaccharides and oligosaccharides. Unless otherwise noted, heterocycloalkyls have from 2 to 12 carbons in the ring. In some embodiments, heterocycloalkyls have from 2 to 10 carbons in the ring. In some embodiments, heterocycloalkyls have from 2 to 10 carbons in the ring and 1 or 2 N atoms. In some embodiments, heterocycloalkyls have from 2 to 10 carbons in the ring and 3 or 4 N atoms. In some embodiments, heterocycloalkyls have from 2 to 12 carbons, 0-2 N atoms, 0-2 O atoms, 0-2 P atoms, and 0-1 S atoms in the ring. In some embodiments, heterocycloalkyls have from 2 to 12 carbons, 1-3 N atoms, 0-1 O atoms, and 0-1 S atoms in the ring. It is understood that when referring to the number of carbon atoms in a heterocycloalkyl, the number of carbon atoms in the heterocycloalkyl is not the same as the total number of atoms (including the heteroatoms) that make up the heterocycloalkyl (i.e. skeletal atoms of the heterocycloalkyl ring). Unless stated otherwise specifically in the specification, a heterocycloalkyl group may be optionally substituted. As used herein, the term "teterocycloalkylene" can refer to a divalent heterocycloalkyl group.

The term "heteroaryl" refers to an aryl group that includes one or more ring heteroatoms selected from nitrogen, oxygen and sulfur. The heteroaryl is monocyclic or bicyclic. Illustrative examples of monocyclic heteroaryls include pyridinyl, imidazolyl, pyrimidinyl, pyrazolyl, triazolyl, pyrazinyl, tetrazolyl, furyl, thienyl, isoxazolyl, thiazolyl, oxazolyl, isothiazolyl, pyrrolyl, pyridazinyl, triazinyl, oxadiazolyl, thiadiazolyl, furazanyl, indolizine, indole, benzofuran, benzothiophene, indazole, benzimidazole, purine, quinolizine, quinoline, isoquinoline, cinnoline, phthalazine, quinazoline, quinoxaline, 1,8-naphthyridine, and pteridine. Illustrative examples of monocyclic heteroaryls include pyridinyl, imidazolyl, pyrimidinyl, pyrazolyl, triazolyl, pyrazinyl, tetrazolyl, furyl, thienyl, isoxazolyl, thiazolyl, oxazolyl, isothiazolyl, pyrrolyl, pyridazinyl, triazinyl, oxadiazolyl, thiadiazolyl, and furazanyl. Illustrative examples of bicyclic heteroaryls include indolizine, indole, benzofuran, benzothiophene, indazole, benzimidazole, purine, quinolizine, quinoline, isoquinoline, cinnoline, phthalazine, quinazoline, quinoxaline, 1,8-naphthyridine, and pteridine. In some embodiments, heteroaryl is pyridinyl, pyrazinyl, pyrimidinyl, thiazolyl, thienyl, thiadiazolyl or furyl. In some embodiments, a heteroaryl contains 0-6 N atoms in the ring. In some embodiments, a heteroaryl contains 1-4 N atoms in the ring. In some embodiments, a heteroaryl contains 4-6 N atoms in the ring. In some embodiments, a heteroaryl contains 0-4 N atoms, 0-1 O atoms, 0-1 P atoms, and 0-1 S atoms in the ring. In some embodiments, a heteroaryl contains 1-4 N atoms, 0-1 O atoms, and 0-1 S atoms in the ring. In some embodiments, heteroaryl is a $C_1$-$C_9$ heteroaryl. In some embodiments, monocyclic heteroaryl is a $C_1$-$C_5$ heteroaryl. In some embodiments, monocyclic heteroaryl is a 5-membered or 6-membered heteroaryl. In some embodiments, a bicyclic heteroaryl is a $C_6$-$C_9$ heteroaryl. In some embodiments, a heteroaryl group is partially reduced to form a heterocycloalkyl group defined herein. In some embodiments, a heteroaryl group is fully reduced to form a heterocycloalkyl group defined herein.

As used herein, the "N/P ratio" is the molar ratio of ionizable (e.g., in the physiological pH range) nitrogen atoms in a lipid (or lipids) to phosphate groups in a nucleic acid molecular entity (or nucleic acid molecular entities), e.g., in a nanoparticle composition comprising a lipid component and an RNA. Ionizable nitrogen atoms can include, for example, nitrogen atoms that can be protonated at about pH 1, about pH 2, about pH 3, about pH 4, about pH5, about pH 6, about pH 7, about pH 7.5, or about pH 8 or higher. The physiological pH range can include, for example, the pH range of different cellular compartments (such as organs, tissues, and cells) and bodily fluids (such as blood, CSF, gastric juice, milk, bile, saliva, tears, and urine). In certain specific embodiments, the physiological pH range refers to the pH range of blood in a mammal, for example, from about 7.35 to about 7.45. Similarly, for phosphate charge neutralizers that have one or more ionizable nitrogen atoms, the N/P ratio can refer to a molar ratio of ionizable nitrogen atoms in the phosphate charge neutralizer to the phosphate groups in a nucleic acid. In some embodiments, ionizable nitrogen atoms refer to those nitrogen atoms that are ionizable within a pH range between 5 and 14.

It is further contemplated that the LNP formulations that encapsulate the gRNAs and mRNAs drug substances described herein may be modified to include GalNac lipid formulations such as those disclosed in co-owned U.S. patent application Ser. No. 17/192,709 filed on Mar. 4, 2021 with a parallel PCT application being filed on same date having International Application Number PCT/US21/20955. Employment of such GalNac lipid formulations are understood to be capable of enhancing LNP uptake in LDL-R deficient cells, such as those associated with heterozygous and homozygous familial hypercholesterolemia patient populations.

For the payload that does not contain a phosphate group, the N/P ratio can refer to a molar ratio of ionizable nitrogen atoms in a lipid to the total negative charge in the payload. For example, the N/P ratio of an LNP composition can refer to a molar ratio of the total ionizable nitrogen atoms in the LNP composition to the total negative charge in the payload that is present in the composition.

As used herein, amino lipids can contain at least one primary, secondary or tertiary amine moiety that is protonatable (or ionizable) between pH range 4 and 14. In some embodiments, the amine moiety/moieties function as the hydrophilic headgroup of the amino lipids. When most of the amine moiety(ies) of an amino lipid (or amino lipids) in a nucleic acid-lipid nanoparticle formulation is protonated at physiological pH, then the nanoparticles can be termed as cationic lipid nanoparticle (cLNP). When most of the amine moiety(ies) of an amino lipid (or amino lipids) in a nucleic acid-lipid nanoparticle formulation is not protonated at physiological pH but can be protonated at acidic pH, endosomal pH for example, can be termed as ionizable lipid nanoparticle (iLNP). The amino lipids that constitute cLNPs can be generally called cationic amino lipids (cLipids). The amino lipids that constitute iLNPs can be called ionizable amino lipids (iLipids). The amino lipid can be an iLipid or a cLipid at physiological pH.

Kits

One aspect of the disclosure relates to kits including the compositions comprising a single guide RNA as provided herein, the base editor system and complex as provided herein, the composition as provided herein, or the lipid nanoparticle as provided herein for treating or preventing a condition. The kits can further include one or more additional therapeutic regimens or agents for treating or preventing a condition.

Also disclosed herein, in certain embodiments, are kits and articles of manufacture for use with one or more methods described herein. Such kits include a carrier, package, or container that is compartmentalized to receive one or more containers such as vials, tubes, and the like, each of the container(s) comprising one of the separate elements to be used in a method described herein. Suitable containers include, for example, bottles, vials, syringes, and test tubes. In one embodiment, the containers are formed from a variety of materials such as glass or plastic.

The articles of manufacture provided herein contain packaging materials. Examples of pharmaceutical packaging materials include, but are not limited to, blister packs, bottles, tubes, bags, containers, bottles, and any packaging material suitable for a selected formulation and intended mode of administration and treatment.

For example, the container(s) include the composition of the disclosure, and optionally in addition with therapeutic regimens or agents disclosed herein. Such kits optionally include an identifying description or label or instructions relating to its use in the methods described herein.

A kit typically includes labels listing contents and/or instructions for use, and package inserts with instructions for use. A set of instructions will also typically be included.

In embodiments, a label is on or associated with the container. In one embodiment, a label is on a container when letters, numbers or other characters forming the label are attached, molded or etched into the container itself, a label is associated with a container when it is present within a receptacle or carrier that also holds the container, e.g., as a package insert. In one embodiment, a label is used to indicate that the contents are to be used for a specific therapeutic application. The label also indicates directions for use of the contents, such as in the methods described herein.

EXAMPLES

Introduction

The present disclosure will be described in greater detail by way of specific examples. These examples are provided for illustrative purposes only and not to limit the scope of the claims provided herein. Those of skill in the art will readily recognize a variety of non-critical parameters that can be changed or modified to yield alternative embodiments according to the present disclosure.

Gene-editing technologies, including CRISPR-Cas9 nucleases and CRISPR base editors, have the potential to precisely and permanently modify disease-causing genes in human patients. The demonstration of durable editing in target organs of non-human primates (NHPs) is an important and necessary step prior to in vivo administration of gene editors to patients in clinical trials. Herein provided is the first demonstration that CRISPR base editors delivered in vivo using lipid nanoparticles (LNP) can efficiently modify disease-related genes in living NHPs. In addition to providing proof-of-concept for a once-and-done approach to reduce cholesterol and treat coronary heart disease, the leading cause of death worldwide, these results demonstrate how CRISPR base editors can be productively applied to a variety of therapeutic target genes in the liver and potentially other organs.

In vivo gene editing is an emerging new therapeutic approach to make DNA modifications in a patient's own body in organs such as the liver. Gene-editing methods include CRISPR-Cas9 and -Cas12 nucleases, CRISPR cytosine base editors, CRISPR adenine base editors, and CRISPR prime editors. The human PCSK9 and ANGPTL3 gene are particularly attractive potential target(s) for in vivo gene editing. In principle, editing of PCSK9 could produce durable reductions in blood LDL-C levels and thereby dramatically lower one's cumulative exposure to LDL-C in contrast to all existing therapies (e.g., statins, ezetimibe, or PCSK9 inhibitors), which must be taken daily or every few weeks to months and can suffer from lack of patient adherence.

In vivo delivery of a gene editor that can introduce a PCSK9 or ANGPTL3 loss-of-function mutation in the liver has the potential to offer a new kind of once-and-done therapy that offers lifelong treatment of coronary heart disease. CRISPR base editors make an attractive gene-editing modality for this purpose because they function efficiently for introducing precise targeted alterations and, in contrast to CRISPR-Cas9 and other gene-editing nucleases, minimize any deleterious consequences of introducing double-strand DNA breaks.

CRISPR adenine base editors can induce targeted A→G edits in DNA (T→C on the opposing strand) and can be used to inactivate genes by disrupting start codons, splice donors (canonical GT sequence on the sense strand) or splice acceptors (canonical AG sequence on the sense strand) at exon-intron or intron-exon boundaries, or introducing missense mutations. Adenine 8.8-m (hereafter referred to as ABE8.8) uses its core *Streptococcus pyogenes* nickase Cas9 (nSpCas9) protein with a guide RNA (gRNA) to engage a double-strand protospacer DNA sequence, flanked by an NGG protospacer-adjacent motif (PAM) sequence on its 3' end. The protospacer sequence is specified via hybridization of the first 20 bases of the gRNA with a complementary sequence on the "target" DNA strand, leaving part of the other ("non-target") strand in exposed single-strand form structure called the R-loop. The ABE base editor uses an evolved deoxyadenosine deaminase domain-fused to nSpCas9-to chemically modify an adenosine nucleoside, contained in the single-stranded DNA portion of the R-loop, into inosine and nicks the target DNA strand within the DNA: RNA heteroduplex of the R-loop. This nick biases DNA repair machinery to use the freshly deaminated strand as a template, enabling highly efficient transition mutation at the targeted site. The activity window of ABE8.8 typically ranges from positions 3 to 9 in the protospacer DNA sequence specified by the gRNA, 12 to 18 base pairs 5' of the NGG PAM (positions 21 to 23), with peak editing observed at position 6 of the protospacer. Although the mechanism of action of ABE8.8 does not involve double-strand DNA breaks, indel mutagenesis can occur low frequency.

The advantages of base editing compared to CRISPR-Cas9 genome editing for gene inactivation or other types of gene alteration is noted. Standard CRISPR-Cas9 editing carries higher risks of unwanted on-target effects and off-target effects emanating from double-strand breaks (large deletions, integration of vector DNA sequences, chromosomal rearrangements, induction of p53 activity, etc.). Even the intended on-target effects-small indel mutations-have an element of unpredictability, as they can result in frameshift mutations that add varied strings of anomalous amino acids at the end of the truncated protein product, or in-frame mutations that add or remove amino acids from the protein without knocking out its function. In contrast, base editing offers a means to efficiently make precise, stereotyped changes in the genome, allowing for more reproducible alteration of gene function. Base editing mitigates unintended on-target effects by virtue of not requiring double-strand breaks but instead acting through enzymatic modification of DNA bases via the deaminase domain.

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents.

Protospacer Selection and Editing

Example 1. gRNA Design for Targeting PCSK9 and ANGPTL3

All protospacers shown in Table 1 and Table 24 were chosen by two criteria. First, they matched (or very closely matched) sequences in the human, cynomolgus monkey, and/or mouse orthologs of the genes. Second, they had favorable predicted off-target profiles, as judged by the MIT Specificity Score (calculated by http://crispor.tefor.net/; minimum score of 50).

Where the goal is to disrupt a gene in vivo for a therapeutic purpose, cytosine base editors have the advantage of being able to directly introduce stop codons into the coding sequence of the gene (nonsense mutations) by altering specific codons for glutamine (CAG→TAG, CAA→TAA), arginine (CGA→TGA), and tryptophan (TGG→TAG/TAA/TGA, with editing of cytosines on the antisense strand). In contrast, adenine base editors cannot directly introduce stop codons, as there are no A→G changes that result in nonsense mutations. Nonetheless, the more favorable off-target profile of adenine base editors, particularly with respect to gRNA-independent off-target DNA base editing, recommend the use of adenine base editors over cytosine base editors for therapeutic purposes. Similar approaches were followed to identify and select mouse/rodent specific protospacers listed in Tables 1 and 24.

One strategy by which adenine base editors might be used to disrupt gene function is to edit the start codon, such as from ATG→GTG or ATG→ACG. Therefore, the resultant translation into protein will not initiate at the canonical ATG site. A second strategy by which adenine base editors might be used to disrupt gene function is to edit splice sites, whether splice donors at the 5' ends of introns or splice acceptors at the 3' ends of introns. Splice site disruption can result in the inclusion of intronic sequences in messenger RNA (mRNA) potentially introducing nonsense, frameshift, or in-frame indel mutations that result in premature stop codons or in insertion/deletion of amino acids that disrupt protein activity- or in the exclusion of exonic sequences, which can also introduce nonsense, frameshift, or in-frame indel mutations. Canonical splice donors comprise the DNA sequence GT on the sense strand, whereas canonical splice acceptors comprise the DNA sequence AG. Alteration of the sequence disrupts normal splicing. Splice donors can be disrupted by adenine base editing of the complementary base in the second position in the antisense strand (GT→GC), and splice acceptors can be disrupted by adenine base editing of the first position in the sense strand (AG→GG). A third strategy by which adenine base editors might be used to disrupt gene function is to introduce a missense mutation(s) into the coding region of the gene that results in production of a less functional, or non-functional protein.

All gRNA spacer sequences that would permit ABE8.8 (and other ABE variants containing *Streptococcus pyogenes* Cas9, such as ABE7.10, or another Cas protein that can use the NGG PAM) to disrupt splice sites were identified, whether donors or acceptors, via A→G editing within its editing window (roughly positions 3 to 9 in the 20-nt protospacer region of DNA) were identified. Guide RNAs matching each of the protospacer sequences and otherwise conforming to the standard 100-nt *Streptococcus pyogenes* CRISPR gRNA sequence were synthesized, with each gRNA molecule having a modest degree of chemical modifications (e.g., in Table 1).

TABLE 1

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA001 | GGTGCTAGCCTTGCGTTCCG | 66 | GsGsUsGCUAGCCUUGCGUUCCG GUUUUAGAgcuagaaauagcAAGUU AAAAUAAGGCUAGUCCGUUAU CAacuugaaaaaguggcaccgagucggugcu sususu | 253 | SpCas9 |
| hcPCSK9 | GA002 | GGTGCTAGCCTTGCGTTCCG | 66 | gsgsusGCUAGCCUUGCGUUCCGG UUUUUAGAgcuagaaauagcAAGUUA AAAUAAGGCUAGUCCGUUAUC Aacuugaaaaaguggcaccgagucggugcusu susu | 253 | SpCas9 |
| hcPCSK9 | GA003 | GGTGCTAGCCTTGCGTTCCG | 66 | gsgsusGCUAGCCUUGCGUUCCGG UUUUsAGAgcuagaaauagcAAGUUs AAAAUsAAGGCUsAGUCCGUUs AUCsAacuugaaaaaguggcaccgagucgg ugcusususu | 254 | SpCas9 |
| hcPCSK9 | GA004 | GGTGCTAGCCTTGCGTTCCG | 66 | gsgsusGCUAGCCUUGCGUUCCGg UUUUAGagcuagaaauagcaaGUUaAa AuAaggcuaGUccGUUAucAAcuugaa aaagugGcaccgagucggugcuuuuu | 255 | SpCas9 |
| hcPCSK9 | GA005 | GGTGCTAGCCTTGCGTTCCG | 66 | GsGsUsGCUAGCCUUGCGUUCCG gUUUUAGagcuagaaauagcaaGUUaA aAuAaggcuaGUccGUUAucAAcuuga aaagugGcaccgagucggugcuuuuu | 255 | SpCas9 |
| hcPCSK9 | GA006 | GGTGCTAGCCTTGCGTTCCG | 66 | GsGsUsGCUAGCCUUGCGUUCCG gUUUUAGagcuagaaauagcaaGUUaA aAuAaggcuaGUccGUUAucAAcuuga aaaagugGcaccgagucggugcusususu | 253 | SpCas9 |
| hcPCSK9 | GA007 | GGTGCTAGCCTTGCGTTCCG | 66 | gsgsusGCUAGCCUUGCGUUCCGg UUUUAGagcuagaaauagcaaGUUaAa AuAaggcuaGUccGUUAucAAcuugaa aaagugGcaccgagucggugcusususu | 253 | SpCas9 |
| hcPCSK9 | GA007/ GA252 | GGTGCTAGCCTTGCGTTCCG | 66 | gsgsusGCUAGCCUUGCGUUCCGg UUUUAGagcuagaaauagcaaGUUaAa AuAaggcuaGUccGUUAucAAcuugaa aaagugGcaccgagucggugcusususu | 253 | SpCas9 |
| hcPCSK9 | GA008 | GGTGCTAGCCTTGCGTTCCG | 66 | gsgsusGCUAGCCUUGCGUUCCGg UUUUAGagcuagaaauagcaaGUUsA aAuAaggcuaGUccGUUsAucAAcuug aaaaagugGcaccgagucggugcusususu | 256 | SpCas9 |
| hcPCSK9 | GA009 | GGTGCTAGCCTTGCGTTCCG | 66 | gsgsusGCUAGCCUUGCGUUCCGG UUUUAGAGCUAGAAAUAGCAA GUUAAAAUAAGGCUAGUCCGU UAUCAACUUGAAAAAGUGGCA CCGAGUCGGUGCUsususu | 253 | SpCas9 |
| mcPCSK9 | GA052 | CAGGTTCCATGGGATGCTCT | 81 | csasgsGUUCCAUGGGAUGCUCUG UUUUUAGAGCUAGAAAUAGCAA GUUAAAAUAAGGCUAGUCCGU UAUCAACUUGAAAAAGUGGCA CCGAGUCGGUGCUsususu | 55 | SpCas9 |
| mcPCK9 | GA053 | CAGGTTCCATGGGATGCTCT | 81 | csasgsGUUCCAUGGGAUGCUCUG UUUUUAGAgcuagaaauagcAAGUUA AAAUAAGGCUAGUCCGUUAUC Aacuugaaaaaguggcaccgagucggugcusu susu | 55 | SpCas9 |
| mcPCSK9 | GA054 | CAGGTTCCATGGGATGCTCT | 81 | csasgsGUUCCAUGGGAUGCUCUg UUUUAGagcuaGaaauagcaaGUUaAa AuAaggcUaGUccGUUAucAAcuuG aaaaguGgcaccgagucGgugcusususu | 55 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| mcPCSK9 | GA055 | CAGGTTCCATGGGATGCTCT | 81 | csasgsGUUCCAUGGGAUGCUCUg UUUUAGagcuagaaaauagcaaGUUaAa AuAaggcuaGUccGUUAucAAcuugaa aaagugGcaccgagucggugcususus | 55 | SpCas9 |
| hcPCSK9 | GA066/ GA095 | CCCGCACC TTGGCGCA GCGG | 13 | cscscsGCACCUUGGCGCAGCGGG UUUUAGAgcuagaaaauagcAAGUUA AAAUAAGGCUAGUCCGUUAUC Aacuugaaaaaguggcaccgagucggugcusu susu | 9 | ABE/ SpCas9 |
| cANGPTL3 | GA067/ GA101 | AAGATACC TGAATAAC TCTC | 14 | asasgsAUACCUGAAUAACUCUCG UUUUAGAgcuagaaaauagcAAGUUA AAAUAAGGCUAGUCCGUUAUC Aacuugaaaaaguggcaccgagucggugcusu susu | 257 | ABE/ SpCas9 |
| hcPCSK9 | GA072 | GGTGGCTC ACCAGCTC CAGC | 82 | gsgsusGGCUCACCAGCUCCAGCG UUUUAGAGCUAGAAAUAGCAA GUUAAAAUAAGGCUAGUCCGU UAUCAACUUGAAAAAGUGGCA CCGAGUCGGUGCUsususu | 258 | ABE |
| hcPCSK9 | GA073 | GCTTACCT GTCTGTGG AAGC | 67 | gscsusUACCUGUCUGUGGAAGC GUUUUAGAGCUAGAAAUAGCA AGUUAAAAUAAGGCUAGUCCG UUAUCAACUUGAAAAAGUGGC ACCGAGUCGGUGCUsususu | 259 | ABE |
| hcPCSK9 | GA074 | TGCTTACC TGTCTGTG GAAG | 68 | usgscsUUACCUGUCUGUGGAAG GUUUUAGAGCUAGAAAUAGCA AGUUAAAAUAAGGCUAGUCCG UUAUCAACUUGAAAAAGUGGC ACCGAGUCGGUGCUsususu | 260 | ABE |
| hPCSK9 | GA075 | TTGGAAAG ACGGAGG CAGCC | 83 | ususgsGAAAGACGGAGGCAGCC GUUUUAGAGCUAGAAAUAGCA AGUUAAAAUAAGGCUAGUCCG UUAUCAACUUGAAAAAGUGGC ACCGAGUCGGUGCUsususu | 261 | ABE |
| hPCSK9 | GA076 | GAAAGAC GGAGGCA GCCTGG | 84 | gsasasAGACGGAGGCAGCCUGGG UUUUAGAGCUAGAAAUAGCAA GUUAAAAUAAGGCUAGUCCGU UAUCAACUUGAAAAAGUGGCA CCGAGUCGGUGCUsususu | 262 | ABE |
| hcPCSK9 | GA077 | TCCCAGGC CTGGAGTT TATT | 85 | uscscsCAGGCCUGGAGUUUAUU GUUUUAGAGCUAGAAAUAGCA AGUUAAAAUAAGGCUAGUCCG UUAUCAACUUGAAAAAGUGGC ACCGAGUCGGUGCUsususu | 263 | ABE |
| hPCSK9 | GA078 | AGCACCTA CCTCGGGA GCTG | 86 | asgscsACCUACCUCGGGAGCUGG UUUUAGAGCUAGAAAUAGCAA GUUAAAAUAAGGCUAGUCCGU UAUCAACUUGAAAAAGUGGCA CCGAGUCGGUGCUsususu | 264 | ABE |
| hcPCSK9 | GA079 | CTTTCCAG GTCATCAC AGTT | 87 | csususUCCAGGUCAUCACAGUUG UUUUAGAGCUAGAAAUAGCAA GUUAAAAUAAGGCUAGUCCGU UAUCAACUUGAAAAAGUGGCA CCGAGUCGGUGCUsususu | 265 | ABE |
| hcPCSK9 | GA080 | CCTTTCCA GGTCATCA CAGT | 88 | cscsusUUCCAGGUCAUCACAGUG UUUUAGAGCUAGAAAUAGCAA GUUAAAAUAAGGCUAGUCCGU UAUCAACUUGAAAAAGUGGCA CCGAGUCGGUGCUsususu | 266 | ABE |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA081 | TTTCCAGGTCATCACAGTTG | 89 | usususCCAGGUCAUCACAGUUGGUUUUAGAGCUAGAAAUAGCAAGUUAAAAUAAGGCUAGUCCGUUAUCAACUUGAAAAAGUGGCACCGAGUCGGUGCUsususu | 267 | ABE |
| hPCSK9 | GA082 | CTTACCTGCCCCATGGGTGC | 90 | csususACCUGCCCCAUGGGUGCGUUUUAGAGCUAGAAAUAGCAAGUUAAAAUAAGGCUAGUCCGUUAUCAACUUGAAAAAGUGGCACCGAGUCGGUGCUsususu | 268 | ABE |
| hPCSK9 | GA083 | TAAGGCCCAAGGGGGCAAGC | 91 | usasasGGCCCAAGGGGGCAAGCGUUUUAGAGCUAGAAAUAGCAAGUUAAAAUAAGGCUAGUCCGUUAUCAACUUGAAAAAGUGGCACCGAGUCGGUGCUsususu | 269 | ABE |
| hPCSK9 | GA084 | CCTCTTCACCTGCTCCTGAG | 92 | cscsusCUUCACCUGCUCCUGAGGUUUUAGAGCUAGAAAUAGCAAGUUAAAAUAAGGCUAGUCCGUUAUCAACUUGAAAAAGUGGCACCGAGUCGGUGCUsususu | 270 | ABE |
| hPCSK9 | GA085 | GCCTCTTCACCTGCTCCTGA | 93 | gscscsUCUUCACCUGCUCCUGAGGUUUUAGAGCUAGAAAUAGCAAGUUAAAAUAAGGCUAGUCCGUUAUCAACUUGAAAAAGUGGCACCGAGUCGGUGCUsususu | 271 | ABE |
| hPCSK9 | GA086 | TTCACCTGCTCCTGAGGGGC | 94 | ususcsACCUGCUCCUGAGGGGCGUUUUAGAGCUAGAAAUAGCAAGUUAAAAUAAGGCUAGUCCGUUAUCAACUUGAAAAAGUGGCACCGAGUCGGUGCUsususu | 272 | ABE |
| hcPCSK9 | GA087 | TCACCTGCTCCTGAGGGGCC | 95 | uscsasCCUGCUCCUGAGGGGCCGUUUUAGAGCUAGAAAUAGCAAGUUAAAAUAAGGCUAGUCCGUUAUCAACUUGAAAAAGUGGCACCGAGUCGGUGCUsususu | 273 | ABE |
| hcPCSK9 | GA088 | CCCAGGCTGCAGCTCCCACT | 96 | cscscsAGGCUGCAGCUCCCACUGUUUUAGAGCUAGAAAUAGCAAGUUAAAAUAAGGCUAGUCCGUUAUCAACUUGAAAAAGUGGCACCGAGUCGGUGCUsususu | 274 | ABE |
| hPCSK9 | GA089 | CCCCAGGCTGCAGCTCCCAC | 97 | cscscsCAGGCUGCAGCUCCCACGUUUUAGAGCUAGAAAUAGCAAGUUAAAAUAAGGCUAGUCCGUUAUCAACUUGAAAAAGUGGCACCGAGUCGGUGCUsususu | 275 | ABE |
| hPCSK9 | GA090 | GCAGGTGACCGTGGCCTGCG | 98 | gscsasGGUGACCGUGGCCUGCGGUUUUAGAGCUAGAAAUAGCAAGUUAAAAUAAGGCUAGUCCGUUAUCAACUUGAAAAAGUGGCACCGAGUCGGUGCUsususu | 276 | ABE |
| hANGPTL3 | GA091 | AAGATACCTGAATAACCCTC | 15 | asasgsAUACCUGAAUAACCCUCGUUUUAGAGCUAGAAAUAGCAAGUUAAAAUAAGGCUAGUCCGUUAUCAACUUGAAAAAGUGGCACCGAGUCGGUGCUsususu | 59 | ABE |
| hcANGPTL3 | GA092 | CTCCTTTAGGAGGCTGGTGG | 99 | csuscsCUUUAGGAGGCUGGUGGGUUUUAGAGCUAGAAAUAGCAAGUUAAAAUAAGGCUAGUCCGUUAUCAACUUGAAAAAGUGGCACCGAGUCGGUGCUsususu | 277 | ABE |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hANGPTL3 | GA093 | TTTTCAGGAGAATTTTGGTT | 100 | usususUCAGGAGAAUUUUGGUUGUUUUAGAGCUAGAAAUAGCAAGUUAAAAUAAGGCUAGUCCGUUAUCAACUUGAAAAGUGGCACCGAGUCGGUGCUusususu | 278 | ABE |
| hANGPTL3 | GA094/GA153 | CTTTTCAGGAGAATTTTGGT | 101 | csusuUUCAGGAGAAUUUUGGUGUUUUAGAGCUAGAAAUAGCAAGUUAAAAUAAGGCUAGUCCGUUAUCAACUUGAAAAGUGGCACCGAGUCGGUGCUusususu | 279 | ABE |
| hcPCSK9 | GA095/GA066 | CCCGCACCTTGGCGCAGCGG | 13 | cscscsGCACCUUGGCGCAGCGGGUUUUAGAgcuaGaaauagcAAGUUAAAAUAAGGCUAGUCCGUUAUCAacuugaaaaaguGgcaccgagucggugcususu | 9 | ABE |
| hcPCSK9 | GA096 | CCCGCACCTTGGCGCAGCGG | 13 | cscscsGCACCUUGGCGCAGCGgUUUUAGAgcuaGaaauagcaaGUUaAaAuAaggCUaGUCcGUUAucAAcuuGaaaaguGgcaccgAgUCggugcusususu | 9 | ABE |
| hcPCSK9 | GA097 | CCCGCACCTTGGCGCAGCGG | 13 | cscscsGCACCUUGGCGCAGCGgUUUUAGAgcuagaaauagcaaGUUaAaAuAaggcuaGUccGUUAucAAcuugaaaagugGcaccgagucggugcusususu | 9 | ABE |
| hANGPTL3 | GA098 | AAGATACCTGAATAACCCTC | 15 | asasgsAUACCUGAAUAACCCUCGUUUUAGAgcuagaaauagcAAGUUAAAAUAAGGCUAGUCCGUUAUCAacuugaaaaaguggcaccgagucggugcususu | 59 | ABE |
| hANGPTL3 | GA099 | AAGATACCTGAATAACCCTC | 15 | asasgsAUACCUGAAUAACCCUCgUUUUAGAgcuaGaaauagcaaGUUaAaAuAaggCUaGUCcGUUAucAAcuuGaaaaguGgcaccgAgUCggugcusususu | 59 | ABE |
| hANGPTL3 | GA100 | AAGATACCTGAATAACCCTC | 15 | asasgsAUACCUGAAUAACCCUCgUUUUAGAgcuagaaauagcaaGUUaAaAuAaggcuaGUccGUUAucAAcuugaaaagugGcaccgagucggugcusususu | 59 | ABE |
| cANGPTL3 | GA101/GA067 | AAGATACCTGAATAACTCTC | 14 | asasgsAUACCUGAAUAACUCUCGUUUUAGAgcuagaaauagcAAGUUAAAAUAAGGCUAGUCCGUUAUCAacuugaaaaaguggcaccgagucggugcususu | 257 | ABE |
| cANGPTL3 | GA102 | AAGATACCTGAATAACTCTC | 14 | asasgsAUACCUGAAUAACUCUCgUUUUAGAgcuaGaaauagcaaGUUaAaAuAaggCUaGUCcGUUAucAAcuuGaaaaguGgcaccgAgUCggugcusususu | 257 | ABE |
| cANGPTL3 | GA103 | AAGATACCTGAATAACTCTC | 14 | asasgsAUACCUGAAUAACUCUCgUUUUAGAgcuagaaauagcaaGUUaAaAuAaggcuaGUccGUUAucAAcuugaaaagugGcaccgagucggugcusususu | 257 | ABE |
| hANGPTL3 | GA104 | TAATTTGGCCCTTCGTCTTA | 102 | usasasUUUGGCCCUUCGUCUUAGUUUUAGAGCUAGAAAUAGCAAGUUAAAAUAAGGCUAGUCCGUUAUCAACUUGAAAAGUGGCACCGAGUCGGUGCUusususu | 280 | ABE |
| hANGPTL3 | GA105 | AGACTTTGTCCATAAGACGA | 103 | asgsasCUUUGUCCAUAAGACGAGUUUUAGAGCUAGAAAUAGCAAGUUAAAAUAAGGCUAGUCCGUUAUCAACUUGAAAAGUGGCACCGAGUCGGUGCUusususu | 281 | ABE |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hANGPTL3 | GA106 | GACTTTGTCCATAAGACGAA | 104 | gsascsUUUGUCCAUAAGACGAAGUUUUAGAGCUAGAAAUAGCAAGUUAAAAUAAGGCUAGUCCGUUAUCAACUUGAAAAAGUGGCACCGAGUCGGUGCUsususu | 282 | ABE |
| hcANGPTL3 | GA107 | AGCCAATGGCCTCCTTCAGT | 105 | asgscsCAAUGGCCUCCUUCAGUGUUUUAGAGCUAGAAAUAGCAAGUUAAAAUAAGGCUAGUCCGUUAUCAACUUGAAAAAGUGGCACCGAGUCGGUGCUsususu | 283 | SpCas9 |
| hcANGPTL3 | GA108 | TCCCAACTGAAGGAGGCCAT | 106 | uscscsCAACUGAAGGAGGCCAUGUUUUAGAGCUAGAAAUAGCAAGUUAAAAUAAGGCUAGUCCGUUAUCAACUUGAAAAAGUGGCACCGAGUCGGUGCUsususu | 284 | SpCas9 |
| hcANGPTL3 | GA109 | GGCCTCCTTCAGTTGGGACA | 107 | gsgscsCUCCUUCAGUUGGGACAGUUUUAGAGCUAGAAAUAGCAAGUUAAAAUAAGGCUAGUCCGUUAUCAACUUGAAAAAGUGGCACCGAGUCGGUGCUsususu | 285 | SpCas9 |
| hcANGPTL3 | GA110 | GACCATGTCCCAACTGAAGG | 108 | gsascsCAUGUCCCAACUGAAGGGUUUUAGAGCUAGAAAUAGCAAGUUAAAAUAAGGCUAGUCCGUUAUCAACUUGAAAAAGUGGCACCGAGUCGGUGCUsususu | 286 | SpCas9 |
| hcANGPTL3 | GA111 | GCCAATGGCCTCCTTCAGTT | 109 | gscscsAAUGGCCUCCUUCAGUUGUUUUAGAGCUAGAAAUAGCAAGUUAAAAUAAGGCUAGUCCGUUAUCAACUUGAAAAAGUGGCACCGAGUCGGUGCUsususu | 287 | SpCas9 |
| hANGPTL3 | GA112 | ATTGTCTTGATCAATTCTGG | 110 | asususGUCUUGAUCAAUUCUGGGUUUUAGAGCUAGAAAUAGCAAGUUAAAAUAAGGCUAGUCCGUUAUCAACUUGAAAAAGUGGCACCGAGUCGGUGCUsususu | 288 | ABE/SpCas9 |
| hcANGPTL3 | GA113 | ATTCTGGAGGAAATAACTAG | 111 | asususCUGGAGGAAAUAACUAGGUUUUAGAGCUAGAAAUAGCAAGUUAAAAUAAGGCUAGUCCGUUAUCAACUUGAAAAAGUGGCACCGAGUCGGUGCUsususu | 289 | ABE/SpCas9 |
| hANGPTL3 | GA114 | TCTGGGTGTTCTGGAGTTTC | 112 | uscsusGGGUGUUCUGGAGUUUCGUUUUAGAGCUAGAAAUAGCAAGUUAAAAUAAGGCUAGUCCGUUAUCAACUUGAAAAAGUGGCACCGAGUCGGUGCUsususu | 290 | SpCas9 |
| hcANGPTL3 | GA115 | AACATAGCAAATCTTGATTT | 113 | asascsAUAGCAAAUCUUGAUUUGUUUUAGAGCUAGAAAUAGCAAGUUAAAAUAAGGCUAGUCCGUUAUCAACUUGAAAAAGUGGCACCGAGUCGGUGCUsususu | 291 | ABE/SpCas9 |
| hcANGPTL3 | GA116 | GTAGAATTTTTTCTTCTAGG | 114 | gsusasGAAUUUUUUCUUCUAGGGUUUUAGAGCUAGAAAUAGCAAGUUAAAAUAAGGCUAGUCCGUUAUCAACUUGAAAAAGUGGCACCGAGUCGGUGCUsususu | 292 | ABE/SpCas9 |
| hcANGPTL3 | GA117 | ACTACAAGTCAAAAATGAAG | 115 | ascsusACAAGUCAAAAAUGAAGGUUUUAGAGCUAGAAAUAGCAAGUUAAAAUAAGGCUAGUCCGUUAUCAACUUGAAAAAGUGGCACCGAGUCGGUGCUsususu | 293 | ABE/SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hANGPTL3 | GA118 | TATATTGGTCTTCCACGGTC | 116 | usasusAUUGGUCUUCCACGGUCGUUUUAGAGCUAGAAAUAGCAAGUUAAAAUAAGGCUAGUCCGUUAUCAACUUGAAAAAGUGGCACCGAGUCGGUGCUsususu | 294 | ABE/SpCas9 |
| hANGPTL3 | GA119 | CAAAGACCTTCTCCAGACCG | 117 | csasasAGACCUUCUCCAGACCGGUUUUAGAGCUAGAAAUAGCAAGUUAAAAUAAGGCUAGUCCGUUAUCAACUUGAAAAAGUGGCACCGAGUCGGUGCUsususu | 295 | ABE/SpCas9 |
| hANGPTL3 | GA120 | GGTCTTCCACGGTCTGGAGA | 118 | gsgsusCUUCCACGGUCUGGAGAGUUUUAGAGCUAGAAAUAGCAAGUUAAAAUAAGGCUAGUCCGUUAUCAACUUGAAAAAGUGGCACCGAGUCGGUGCUsususu | 296 | ABE/SpCas9 |
| hANGPTL3 | GA121 | TTGTTTATATTGGTCTTCCA | 119 | ususgsUUUAUAUUGGUCUUCCAGUUUUAGAGCUAGAAAUAGCAAGUUAAAAUAAGGCUAGUCCGUUAUCAACUUGAAAAAGUGGCACCGAGUCGGUGCUsususu | 297 | ABE/SpCas9 |
| hcANGPTL3 | GA122 | CTTTTATTTGACTATGCTGT | 120 | csususUUAUUUGACUAUGCUGUGUUUUAGAGCUAGAAAUAGCAAGUUAAAAUAAGGCUAGUCCGUUAUCAACUUGAAAAAGUGGCACCGAGUCGGUGCUsususu | 298 | ABE/SpCas9 |
| hANGPTL3 | GA123 | AAAGTCTGGATATAGAGAGT | 121 | asasasGUCUGGAUAUAGAGAGUGUUUUAGAGCUAGAAAUAGCAAGUUAAAAUAAGGCUAGUCCGUUAUCAACUUGAAAAAGUGGCACCGAGUCGGUGCUsususu | 299 | ABE/SpCas9 |
| hANGPTL3 | GA124 | GTTGGTTTAATTGTTTATAT | 122 | gsususGGUUUAAUUGUUUAUAUGUUUUAGAGCUAGAAAUAGCAAGUUAAAAUAAGGCUAGUCCGUUAUCAACUUGAAAAAGUGGCACCGAGUCGGUGCUsususu | 300 | ABE/SpCas9 |
| hcANGPTL3 | GA125 | TGATGGTAAGACACTTTGGT | 123 | usgsasUGGUAAGACACUUUGGUGUUUUAGAGCUAGAAAUAGCAAGUUAAAAUAAGGCUAGUCCGUUAUCAACUUGAAAAAGUGGCACCGAGUCGGUGCUsususu | 301 | ABE/SpCas9 |
| hcANGPTL3 | GA126 | GGAGTAGTTCTTGGTGCTCT | 124 | gsgsasGUAGUUCUUGGUGCUCUGUUUUAGAGCUAGAAAUAGCAAGUUAAAAUAAGGCUAGUCCGUUAUCAACUUGAAAAAGUGGCACCGAGUCGGUGCUsususu | 302 | ABE/SpCas9 |
| hcANGPTL3 | GA127 | AACATGATGGTAAGACACTT | 125 | asascsAUGAUGGUAAGACACUUGUUUUAGAGCUAGAAAUAGCAAGUUAAAAUAAGGCUAGUCCGUUAUCAACUUGAAAAAGUGGCACCGAGUCGGUGCUsususu | 303 | ABE/SpCas9 |
| hcANGPTL3 | GA128 | TGAAGAAAGGGAGTAGTTCT | 126 | usgsasAGAAAGGGAGUAGUUCUGUUUUAGAGCUAGAAAUAGCAAGUUAAAAUAAGGCUAGUCCGUUAUCAACUUGAAAAAGUGGCACCGAGUCGGUGCUsususu | 304 | ABE/SpCas9 |
| hcANGPTL3 | GA129 | AGTTCTTGGTGCTCTTGGCT | 127 | asgsusUCUUGGUGCUCUUGGCUGUUUUAGAGCUAGAAAUAGCAAGUUAAAAUAAGGCUAGUCCGUUAUCAACUUGAAAAAGUGGCACCGAGUCGGUGCUsususu | 305 | ABE/SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcANGPTL3 | GA130 | ATGATGGTAAGACACTTTGG | 128 | asusgsAUGGUAAGACACUUUGG GUUUUAGAGCUAGAAAUAGCA AGUUAAAAUAAGGCUAGUCCG UUAUCAACUUGAAAAAGUGGC ACCGAGUCGGUGCUsususu | 306 | ABE/ SpCas9 |
| hcANGPTL3 | GA131 | GAAGATAGAGAAATTTCTGT | 129 | gsasasGAUAGAGAAAUUUCUGU GUUUUAGAGCUAGAAAUAGCA AGUUAAAAUAAGGCUAGUCCG UUAUCAACUUGAAAAAGUGGC ACCGAGUCGGUGCUsususu | 307 | ABE/ SpCas9 |
| hcANGPTL3 | GA132 | GGAAGATAGAGAAATTTCTG | 130 | gsgsasAGAUAGAGAAAUUUCUG GUUUUAGAGCUAGAAAUAGCA AGUUAAAAUAAGGCUAGUCCG UUAUCAACUUGAAAAAGUGGC ACCGAGUCGGUGCUsususu | 308 | ABE/ SpCas9 |
| hANGPTL3 | GA133 | TATTTCATTCAACTGAAGAA | 131 | usasusUUCAUUCAACUGAAGAA GUUUUAGAGCUAGAAAUAGCA AGUUAAAAUAAGGCUAGUCCG UUAUCAACUUGAAAAAGUGGC ACCGAGUCGGUGCUsususu | 309 | ABE/ SpCas9 |
| hANGPTL3 | GA134 | ATTTCATTCAACTGAAGAAA | 132 | asususUCAUUCAACUGAAGAAA GUUUUAGAGCUAGAAAUAGCA AGUUAAAAUAAGGCUAGUCCG UUAUCAACUUGAAAAAGUGGC ACCGAGUCGGUGCUsususu | 310 | ABE/ SpCas9 |
| hANGPTL3 | GA135 | GTCTACTGTGATGTTATATC | 133 | gsuscsUACUGUGAUGUUAUAUC GUUUUAGAGCUAGAAAUAGCA AGUUAAAAUAAGGCUAGUCCG UUAUCAACUUGAAAAAGUGGC ACCGAGUCGGUGCUsususu | 311 | ABE/ SpCas9 |
| hANGPTL3 | GA136 | TAAATGGTGGTACATTCAGC | 134 | usasasAUGGUGGUACAUUCAGC GUUUUAGAGCUAGAAAUAGCA AGUUAAAAUAAGGCUAGUCCG UUAUCAACUUGAAAAAGUGGC ACCGAGUCGGUGCUsususu | 312 | ABE/ SpCas9 |
| hcANGPTL3 | GA137 | TATCAGGTAAAACCTGTCTA | 135 | usasusCAGGUAAAACCUGUCUA GUUUUAGAGCUAGAAAUAGCA AGUUAAAAUAAGGCUAGUCCG UUAUCAACUUGAAAAAGUGGC ACCGAGUCGGUGCUsususu | 313 | ABE/ SpCas9 |
| hANGPTL3 | GA138 | TGTACCACCATTTATAACAG | 136 | usgsusACCACCAUUUAUAACAG GUUUUAGAGCUAGAAAUAGCA AGUUAAAAUAAGGCUAGUCCG UUAUCAACUUGAAAAAGUGGC ACCGAGUCGGUGCUsususu | 314 | ABE/ SpCas9 |
| hANGPTL3 | GA139 | TTCACCTCTGTTATAAATGG | 137 | ususcsACCUCUGUUAUAAAUGG GUUUUAGAGCUAGAAAUAGCA AGUUAAAAUAAGGCUAGUCCG UUAUCAACUUGAAAAAGUGGC ACCGAGUCGGUGCUsususu | 315 | ABE/ SpCas9 |
| hANGPTL3 | GA140 | AACAGAGGTGAACATACAAG | 138 | asascsAGAGGUGAACAUACAAG GUUUUAGAGCUAGAAAUAGCA AGUUAAAAUAAGGCUAGUCCG UUAUCAACUUGAAAAAGUGGC ACCGAGUCGGUGCUsususu | 316 | ABE/ SpCas9 |
| hcANGPTL3 | GA141 | TTGAGAGTTGCTGGGTCTGA | 139 | ususgsAGAGUUGCUGGGUCUGA GUUUUAGAGCUAGAAAUAGCA AGUUAAAAUAAGGCUAGUCCG UUAUCAACUUGAAAAAGUGGC ACCGAGUCGGUGCUsususu | 317 | ABE/ SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcANGPTL3 | GA142 | TGAAAAACTTGAGAGTTGCT | 140 | usgsasAAAACUUGAGAGUUGCUGUUUUAGAGCUAGAAAUAGCAAGUUAAAAUAAGGCUAGUCCGUUAUCAACUUGAAAAAGUGGCACCGAGUCGGUGCUsususu | 318 | SpCas9 |
| hcANGPTL3 | GA143 | TTAATTCAACATCGAATAGA | 141 | ususasAUUCAACAUCGAAUAGAGUUUUAGAGCUAGAAAUAGCAAGUUAAAAUAAGGCUAGUCCGUUAUCAACUUGAAAAAGUGGCACCGAGUCGGUGCUsususu | 319 | ABE/SpCas9 |
| hANGPTL3 | GA144 | TTTGGGAGGCTTGATGGTAA | 142 | usususGGGAGGCUUGAUGGUAAGUUUUAGAGCUAGAAAUAGCAAGUUAAAAUAAGGCUAGUCCGUUAUCAACUUGAAAAAGUGGCACCGAGUCGGUGCUsususu | 320 | ABE/SpCas9 |
| hcANGPTL3 | GA145 | CATTATATTCAGGTAGTCCA | 143 | csasusUAUAUUCAGGUAGUCCAGUUUUAGAGCUAGAAAUAGCAAGUUAAAAUAAGGCUAGUCCGUUAUCAACUUGAAAAAGUGGCACCGAGUCGGUGCUsususu | 321 | ABE/SpCas9 |
| hANGPTL3 | GA146 | TTGGGAGGCTTGATGGTAAG | 144 | ususgsGGAGGCUUGAUGGUAAGGUUUUAGAGCUAGAAAUAGCAAGUUAAAAUAAGGCUAGUCCGUUAUCAACUUGAAAAAGUGGCACCGAGUCGGUGCUsususu | 322 | ABE/SpCas9 |
| hANGPTL3 | GA147 | TTTTGGGAGGCTTGATGGTA | 145 | ususUsUGGGAGGCUUGAUGGUAGUUUUAGAGCUAGAAAUAGCAAGUUAAAAUAAGGCUAGUCCGUUAUCAACUUGAAAAAGUGGCACCGAGUCGGUGCUsususu | 323 | ABE/SpCas9 |
| hcANGPTL3 | GA148 | ACAAAACTTCAATGAAACGT | 146 | ascsasAAACUUCAAUGAAACGUGUUUUAGAGCUAGAAAUAGCAAGUUAAAAUAAGGCUAGUCCGUUAUCAACUUGAAAAAGUGGCACCGAGUCGGUGCUsususu | 324 | ABE/SpCas9 |
| hANGPTL3 | GA149 | TATGGTTTTGGGAGGCTTGA | 147 | usasusGGUUUUGGGAGGCUUGAGUUUUAGAGCUAGAAAUAGCAAGUUAAAAUAAGGCUAGUCCGUUAUCAACUUGAAAAAGUGGCACCGAGUCGGUGCUsususu | 325 | ABE/SpCas9 |
| hANGPTL3 | GA150 | ACTACAAATATGGTTTTGGG | 148 | ascsusACAAAUAUGGUUUUGGGGUUUUAGAGCUAGAAAUAGCAAGUUAAAAUAAGGCUAGUCCGUUAUCAACUUGAAAAAGUGGCACCGAGUCGGUGCUsususu | 326 | ABE/SpCas9 |
| hcANGPTL3 | GA151 | GAGAACTACAAATATGGTTT | 149 | gsasgsAACUACAAAUAUGGUUUGUUUUAGAGCUAGAAAUAGCAAGUUAAAAUAAGGCUAGUCCGUUAUCAACUUGAAAAAGUGGCACCGAGUCGGUGCUsususu | 327 | ABE/SpCas9 |
| hANGPTL3 | GA152 | AGGACACTTCAACTGTCCAG | 150 | asgsgsACACUUCAACUGUCCAGGUUUUAGAGCUAGAAAUAGCAAGUUAAAAUAAGGCUAGUCCGUUAUCAACUUGAAAAAGUGGCACCGAGUCGGUGCUsususu | 328 | ABE/SpCas9 |
| hANGPTL3 | GA094/GA153 | CTTTTCAGGAGAATTTTGGT | 101 | csususUUCAGGAGAAUUUUGGUGUUUUAGAGCUAGAAAUAGCAAGUUAAAAUAAGGCUAGUCCGUUAUCAACUUGAAAAAGUGGCACCGAGUCGGUGCUsususu | 279 | ABE/SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA156 | GGTGCTAGCCTTGCGTTCCG | 66 | gsgsusGCUAGCCUUGCGUUCCGGUUUUAGAGCUAGAAAUAGCAAGUUAAAAUAAGGCUAGUCCGUUAUCAACUUGAAAAAGUGGCACCGAGUCGGUGCUsususu | 253 | SpCas9 |
| hcPCSK9 | GA157 | GCCGTCCTCCTCGGAACGCA | 151 | gscscsGUCCUCCUCGGAACGCAGUUUUAGAGCUAGAAAUAGCAAGUUAAAAUAAGGCUAGUCCGUUAUCAACUUGAAAAAGUGGCACCGAGUCGGUGCUsususu | 329 | SpCas9 |
| hcPCSK9 | GA158 | GCTAGCCTTGCGTTCCGAGG | 152 | gscsusAGCCUUGCGUUCCGAGGGUUUUAGAGCUAGAAAUAGCAAGUUAAAAUAAGGCUAGUCCGUUAUCAACUUGAAAAAGUGGCACCGAGUCGGUGCUsususu | 330 | SpCas9 |
| hcPCSK9 | GA159 | GCGTTCCGAGGAGGACGGCC | 153 | gscsgsUUCCGAGGAGGACGGCCGUUUUAGAGCUAGAAAUAGCAAGUUAAAAUAAGGCUAGUCCGUUAUCAACUUGAAAAAGUGGCACCGAGUCGGUGCUsususu | 331 | SpCas9 |
| hcPCSK9 | GA160 | GCCTTGCGTTCCGAGGAGGA | 154 | gscscsUUGCGUUCCGAGGAGGAGUUUUAGAGCUAGAAAUAGCAAGUUAAAAUAAGGCUAGUCCGUUAUCAACUUGAAAAAGUGGCACCGAGUCGGUGCUsususu | 332 | SpCas9 |
| hcPCSK9 | GA161 | GGACGAGGACGGCGACTACG | 155 | gsgsasCGAGGACGGCGACUACGGUUUUAGAGCUAGAAAUAGCAAGUUAAAAUAAGGCUAGUCCGUUAUCAACUUGAAAAAGUGGCACCGAGUCGGUGCUsususu | 333 | SpCas9 |
| hcPCSK9 | GA162 | GGACGGCGACTACGAGGAGC | 156 | gsgsasCGGCGACUACGAGGAGCGUUUUAGAGCUAGAAAUAGCAAGUUAAAAUAAGGCUAGUCCGUUAUCAACUUGAAAAAGUGGCACCGAGUCGGUGCUsususu | 334 | SpCas9 |
| hcPCSK9 | GA163 | CGTCCTCGTCCTCCTGCGCA | 157 | csgsusCCUCGUCCUCCUGCGCAGUUUUAGAGCUAGAAAUAGCAAGUUAAAAUAAGGCUAGUCCGUUAUCAACUUGAAAAAGUGGCACCGAGUCGGUGCUsususu | 335 | SpCas9 |
| hcPCSK9 | GA164 | GTCCTCGTCCTCCTGCGCAC | 158 | gsuscsCUCGUCCUCCUGCGCACGUUUUAGAGCUAGAAAUAGCAAGUUAAAAUAAGGCUAGUCCGUUAUCAACUUGAAAAAGUGGCACCGAGUCGGUGCUsususu | 336 | SpCas9 |
| hcPCSK9 | GA165 | CCGTCAGCTCCAGGCGGTCC | 159 | cscsgsUCAGCUCCAGGCGGUCCGUUUUAGAGCUAGAAAUAGCAAGUUAAAAUAAGGCUAGUCCGUUAUCAACUUGAAAAAGUGGCACCGAGUCGGUGCUsususu | 337 | SpCas9 |
| hcPCSK9 | GA166 | CGCCCGTGCGCAGGAGGACG | 160 | csgscsCCGUGCGCAGGAGGACGGUUUUAGAGCUAGAAAUAGCAAGUUAAAAUAAGGCUAGUCCGUUAUCAACUUGAAAAAGUGGCACCGAGUCGGUGCUsususu | 338 | SpCas9 |
| hcPCSK9 | GA167 | TCAGCTCCAGGCGGTCCTGG | 161 | uscsasGCUCCAGGCGGUCCUGGGUUUUAGAGCUAGAAAUAGCAAGUUAAAAUAAGGCUAGUCCGUUAUCAACUUGAAAAAGUGGCACCGAGUCGGUGCUsususu | 339 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA168 | CTTGGCGCAGCGGTGGAAGG | 162 | csususGGCGCAGCGGUGGAAGGGUUUUAGAGCUAGAAAUAGCAAGUUAAAAUAAGGCUAGUCCGUUAUCAACUUGAAAAAGUGGCACCGAGUCGGUGCUsususu | 340 | SpCas9 |
| hcPCSK9 | GA169 | CGTGCGCAGGAGGACGAGGA | 163 | csgsusGCGCAGGAGGACGAGGAGUUUUAGAGCUAGAAAUAGCAAGUUAAAAUAAGGCUAGUCCGUUAUCAACUUGAAAAAGUGGCACCGAGUCGGUGCUsususu | 341 | SpCas9 |
| hcPCSK9 | GA170 | CCAGGACCGCCTGGAGCTGA | 164 | cscsasGGACCGCCUGGAGCUGAGUUUUAGAGCUAGAAAUAGCAAGUUAAAAUAAGGCUAGUCCGUUAUCAACUUGAAAAAGUGGCACCGAGUCGGUGCUsususu | 342 | SpCas9 |
| hcPCSK9 | GA171 | TCTTGGTGAGGTATCCCCGG | 165 | uscsusUGGUGAGGUAUCCCCGGGUUUUAGAGCUAGAAAUAGCAAGUUAAAAUAAGGCUAGUCCGUUAUCAACUUGAAAAAGUGGCACCGAGUCGGUGCUsususu | 343 | SpCas9 |
| hcPCSK9 | GA172 | CAGTGCGCTCTGACTGCGAG | 166 | csasgsUGCGCUCUGACUGCGAGGUUUUAGAGCUAGAAAUAGCAAGUUAAAAUAAGGCUAGUCCGUUAUCAACUUGAAAAAGUGGCACCGAGUCGGUGCUsususu | 344 | SpCas9 |
| hcPCSK9 | GA173 | CTTGGTGAGGTATCCCCGGC | 167 | csususGGUGAGGUAUCCCCGGCGUUUUAGAGCUAGAAAUAGCAAGUUAAAAUAAGGCUAGUCCGUUAUCAACUUGAAAAAGUGGCACCGAGUCGGUGCUsususu | 345 | SpCas9 |
| hcPCSK9 | GA174 | GGATCTTGGTGAGGTATCCC | 168 | gsgsasUCUUGGUGAGGUAUCCCGUUUUAGAGCUAGAAAUAGCAAGUUAAAAUAAGGCUAGUCCGUUAUCAACUUGAAAAAGUGGCACCGAGUCGGUGCUsususu | 346 | SpCas9 |
| hcPCSK9 | GA175 | GAAGATGAGTGGCGACCTGC | 169 | gsasasGAUGAGUGGCGACCUGCGUUUUAGAGCUAGAAAUAGCAAGUUAAAAUAAGGCUAGUCCGUUAUCAACUUGAAAAAGUGGCACCGAGUCGGUGCUsususu | 347 | SpCas9 |
| hcPCSK9 | GA176 | AGCACCACCACGTAGGTGCC | 170 | asgscsACCACCACGUAGGUGCCGUUUUAGAGCUAGAAAUAGCAAGUUAAAAUAAGGCUAGUCCGUUAUCAACUUGAAAAAGUGGCACCGAGUCGGUGCUsususu | 348 | SpCas9 |
| hcPCSK9 | GA177 | GGTCGCCACTCATCTTCACC | 171 | gsgsusCGCCACUCAUCUUCACCGUUUUAGAGCUAGAAAUAGCAAGUUAAAAUAAGGCUAGUCCGUUAUCAACUUGAAAAAGUGGCACCGAGUCGGUGCUsususu | 349 | SpCas9 |
| hcPCSK9 | GA178 | CTCCTTCAGCACCACCACGT | 172 | csuscsCUUCAGCACCACCACGUGUUUUAGAGCUAGAAAUAGCAAGUUAAAAUAAGGCUAGUCCGUUAUCAACUUGAAAAAGUGGCACCGAGUCGGUGCUsususu | 350 | SpCas9 |
| hcPCSK9 | GA179 | GAGTGGCGACCTGCTGGAGC | 173 | gsasgsUGGCGACCUGCUGGAGCGUUUUAGAGCUAGAAAUAGCAAGUUAAAAUAAGGCUAGUCCGUUAUCAACUUGAAAAAGUGGCACCGAGUCGGUGCUsususu | 351 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA180 | GCGCACTGCCCGCCGCCTGC | 174 | gscsgsCACUGCCCGCCGCCUGCGUUUUAGAGCUAGAAAUAGCAAGUUAAAAUAAGGCUAGUCCGUUAUCAACUUGAAAAAGUGGCACCGAGUCGGUGCUsususu | 352 | SpCas9 |
| hcPCSK9 | GA181 | GGCTTCCTGGTGAAGATGAG | 175 | gsgscsUUCCUGGUGAAGAUGAGGUUUUAGAGCUAGAAAUAGCAAGUUAAAAUAAGGCUAGUCCGUUAUCAACUUGAAAAAGUGGCACCGAGUCGGUGCUsususu | 353 | SpCas9 |
| hcPCSK9 | GA182 | CACCTACGTGGTGGTGCTGA | 176 | csascsCUACGUGGUGGUGCUGAGUUUUAGAGCUAGAAAUAGCAAGUUAAAAUAAGGCUAGUCCGUUAUCAACUUGAAAAAGUGGCACCGAGUCGGUGCUsususu | 354 | SpCas9 |
| hcPCSK9 | GA183 | CTACGTGGTGGTGCTGAAGG | 177 | csusasCGUGGUGGUGCUGAAGGGUUUUAGAGCUAGAAAUAGCAAGUUAAAAUAAGGCUAGUCCGUUAUCAACUUGAAAAAGUGGCACCGAGUCGGUGCUsususu | 355 | SpCas9 |
| hcPCSK9 | GA184 | ATGGAAGACATGCAGGATCT | 178 | asusgsGAAGACAUGCAGGAUCUGUUUUAGAGCUAGAAAUAGCAAGUUAAAAUAAGGCUAGUCCGUUAUCAACUUGAAAAAGUGGCACCGAGUCGGUGCUsususu | 356 | SpCas9 |
| hcPCSK9 | GA185 | AGACATGCAGGATCTTGGTG | 179 | asgsasCAUGCAGGAUCUUGGUGGUUUUAGAGCUAGAAAUAGCAAGUUAAAAUAAGGCUAGUCCGUUAUCAACUUGAAAAAGUGGCACCGAGUCGGUGCUsususu | 357 | SpCas9 |
| hcPCSK9 | GA186 | CTCATCTTCACCAGGAAGCC | 180 | csuscsAUCUUCACCAGGAAGCCGUUUUAGAGCUAGAAAUAGCAAGUUAAAAUAAGGCUAGUCCGUUAUCAACUUGAAAAAGUGGCACCGAGUCGGUGCUsususu | 358 | SpCas9 |
| hcPCSK9 | GA187 | CTCCTCGATGTAGTCGACAT | 181 | csuscsCUCGAUGUAGUCGACAUGUUUUAGAGCUAGAAAUAGCAAGUUAAAAUAAGGCUAGUCCGUUAUCAACUUGAAAAAGUGGCACCGAGUCGGUGCUsususu | 359 | SpCas9 |
| hcPCSK9 | GA188 | TATTCATCCGCCCGGTACCG | 182 | usasusUCAUCCGCCCGGUACCGGUUUUAGAGCUAGAAAUAGCAAGUUAAAAUAAGGCUAGUCCGUUAUCAACUUGAAAAAGUGGCACCGAGUCGGUGCUsususu | 360 | SpCas9 |
| hcPCSK9 | GA189 | TCCTCGATGTAGTCGACATG | 183 | uscscsUCGAUGUAGUCGACAUGGUUUUAGAGCUAGAAAUAGCAAGUUAAAAUAAGGCUAGUCCGUUAUCAACUUGAAAAAGUGGCACCGAGUCGGUGCUsususu | 361 | SpCas9 |
| hcPCSK9 | GA190 | CCTCCTCGATGTAGTCGACA | 184 | cscsusCCUCGAUGUAGUCGACAGUUUUAGAGCUAGAAAUAGCAAGUUAAAAUAAGGCUAGUCCGUUAUCAACUUGAAAAAGUGGCACCGAGUCGGUGCUsususu | 362 | SpCas9 |
| hcPCSK9 | GA191 | GCCCCATGTCGACTACATCG | 185 | gscscsCCAUGUCGACUACAUCGGUUUUAGAGCUAGAAAUAGCAAGUUAAAAUAAGGCUAGUCCGUUAUCAACUUGAAAAAGUGGCACCGAGUCGGUGCUsususu | 363 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA192 | CCATGTCGACTACATCGAGG | 186 | cscsasUGUCGACUACAUCGAGGGUUUUAGAGCUAGAAAUAGCAAGUUAAAAUAAGGCUAGUCCGUUAUCAACUUGAAAAAGUGGCACCGAGUCGGUGCUsususu | 364 | SpCas9 |
| hcPCSK9 | GA193 | GGGGCTGGTATTCATCCGCC | 187 | gsgsgsGCUGGUAUUCAUCCGCCGUUUUAGAGCUAGAAAUAGCAAGUUAAAAUAAGGCUAGUCCGUUAUCAACUUGAAAAAGUGGCACCGAGUCGGUGCUsususu | 365 | SpCas9 |
| hcPCSK9 | GA194 | GTCGACATGGGGCAACTTCA | 188 | gsuscsGACAUGGGGCAACUUCAGUUUUAGAGCUAGAAAUAGCAAGUUAAAAUAAGGCUAGUCCGUUAUCAACUUGAAAAAGUGGCACCGAGUCGGUGCUsususu | 366 | SpCas9 |
| hcPCSK9 | GA195 | ACCACCGGGAAATCGAGGGC | 189 | ascscsACCGGGAAAUCGAGGGCGUUUUAGAGCUAGAAAUAGCAAGUUAAAAUAAGGCUAGUCCGUUAUCAACUUGAAAAAGUGGCACCGAGUCGGUGCUsususu | 367 | SpCas9 |
| hcPCSK9 | GA196 | GAGTGACCACCGGGAAATCG | 190 | gsasgsUGACCACCGGGAAAUCGGUUUUAGAGCUAGAAAUAGCAAGUUAAAAUAAGGCUAGUCCGUUAUCAACUUGAAAAAGUGGCACCGAGUCGGUGCUsususu | 368 | SpCas9 |
| hcPCSK9 | GA197 | AGTGACCACCGGGAAATCGA | 191 | asgsusGACCACCGGGAAAUCGAGUUUUAGAGCUAGAAAUAGCAAGUUAAAAUAAGGCUAGUCCGUUAUCAACUUGAAAAAGUGGCACCGAGUCGGUGCUsususu | 369 | SpCas9 |
| hcPCSK9 | GA198 | CCACCGGGAAATCGAGGGCA | 192 | cscsasCCGGGAAAUCGAGGGCAGUUUUAGAGCUAGAAAUAGCAAGUUAAAAUAAGGCUAGUCCGUUAUCAACUUGAAAAAGUGGCACCGAGUCGGUGCUsususu | 370 | SpCas9 |
| hcPCSK9 | GA199 | GAAGCGGGTCCCGTCCTCCT | 193 | gsasasGCGGGUCCCGUCCUCCUGUUUUAGAGCUAGAAAUAGCAAGUUAAAAUAAGGCUAGUCCGUUAUCAACUUGAAAAAGUGGCACCGAGUCGGUGCUsususu | 371 | SpCas9 |
| hcPCSK9 | GA200 | CTAGGAGATACACCTCCACC | 194 | csusasGGAGAUACACCUCCACCGUUUUAGAGCUAGAAAUAGCAAGUUAAAAUAAGGCUAGUCCGUUAUCAACUUGAAAAAGUGGCACCGAGUCGGUGCUsususu | 372 | SpCas9 |
| hcPCSK9 | GA201 | CAGCATACAGAGTGACCACC | 195 | csasgsCAUACAGAGUGACCACCGUUUUAGAGCUAGAAAUAGCAAGUUAAAAUAAGGCUAGUCCGUUAUCAACUUGAAAAAGUGGCACCGAGUCGGUGCUsususu | 373 | SpCas9 |
| hcPCSK9 | GA202 | AAGCGGGTCCCGTCCTCCTC | 196 | asasgsCGGGUCCCGUCCUCCUCGUUUUAGAGCUAGAAAUAGCAAGUUAAAAUAAGGCUAGUCCGUUAUCAACUUGAAAAAGUGGCACCGAGUCGGUGCUsususu | 374 | SpCas9 |
| hcPCSK9 | GA203 | TGACCCTGCCCTCGATTTCC | 197 | usgsasCCCUGCCCUCGAUUUCCGUUUUAGAGCUAGAAAUAGCAAGUUAAAAUAAGGCUAGUCCGUUAUCAACUUGAAAAAGUGGCACCGAGUCGGUGCUsususu | 375 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA204 | CACTCTGTATGCTGGTGTCT | 198 | csascsUCUGUAUGCUGGUGUCUG UUUUAGAGCUAGAAAUAGCAA GUUAAAAUAAGGCUAGUCCGU UAUCAACUUGAAAAAGUGGCA CCGAGUCGGUGCUsususu | 376 | SpCas9 |
| hcPCSK9 | GA205 | CCCTGCCCTCGATTTCCCGG | 199 | cscscsUGCCCUCGAUUUCCCGGG UUUUAGAGCUAGAAAUAGCAA GUUAAAAUAAGGCUAGUCCGU UAUCAACUUGAAAAAGUGGCA CCGAGUCGGUGCUsususu | 377 | SpCas9 |
| hcPCSK9 | GA206 | CCGGTGGTCACTCTGTATGC | 200 | cscsgsGUGGUCACUCUGUAUGCG UUUUAGAGCUAGAAAUAGCAA GUUAAAAUAAGGCUAGUCCGU UAUCAACUUGAAAAAGUGGCA CCGAGUCGGUGCUsususu | 378 | SpCas9 |
| hcPCSK9 | GA207 | GGAAATCGAGGGCAGGGTCA | 201 | gsgsasAAUCGAGGGCAGGGUCA GUUUUAGAGCUAGAAAUAGCA AGUUAAAAUAAGGCUAGUCCG UUAUCAACUUGAAAAAGUGGC ACCGAGUCGGUGCUsususu | 379 | SpCas9 |
| hcPCSK9 | GA208 | CCAGCATACAGAGTGACCAC | 202 | cscsasGCAUACAGAGUGACCACG UUUUAGAGCUAGAAAUAGCAA GUUAAAAUAAGGCUAGUCCGU UAUCAACUUGAAAAAGUGGCA CCGAGUCGGUGCUsususu | 380 | SpCas9 |
| hcPCSK9 | GA209 | CTTGGCAGTTGAGCACGCGC | 203 | csusUsGGCAGUUGAGCACGCGCG UUUUAGAGCUAGAAAUAGCAA GUUAAAAUAAGGCUAGUCCGU UAUCAACUUGAAAAAGUGGCA CCGAGUCGGUGCUsususu | 381 | SpCas9 |
| hcPCSK9 | GA210 | CTGCGCGTGCTCAACTGCCA | 204 | csusgsCGCGUGCUCAACUGCCAG UUUUAGAGCUAGAAAUAGCAA GUUAAAAUAAGGCUAGUCCGU UAUCAACUUGAAAAAGUGGCA CCGAGUCGGUGCUsususu | 382 | SpCas9 |
| hcPCSK9 | GA211 | TGCGCGTGCTCAACTGCCAA | 205 | usgscsGCGUGCUCAACUGCCAAG UUUUAGAGCUAGAAAUAGCAA GUUAAAAUAAGGCUAGUCCGU UAUCAACUUGAAAAAGUGGCA CCGAGUCGGUGCUsususu | 383 | SpCas9 |
| hcPCSK9 | GA212 | CGGGATGCCGGCGTGGCCAA | 206 | csgsgsGAUGCCGGCGUGGCCAAG UUUUAGAGCUAGAAAUAGCAA GUUAAAAUAAGGCUAGUCCGU UAUCAACUUGAAAAAGUGGCA CCGAGUCGGUGCUsususu | 384 | SpCas9 |
| hcPCSK9 | GA213 | CGTGCTCAACTGCCAAGGGA | 207 | csgsusGCUCAACUGCCAAGGGAG UUUUAGAGCUAGAAAUAGCAA GUUAAAAUAAGGCUAGUCCGU UAUCAACUUGAAAAAGUGGCA CCGAGUCGGUGCUsususu | 385 | SpCas9 |
| hcPCSK9 | GA214 | CCTTGGCCACGCCGGCATCC | 208 | cscsusUGGCCACGCCGGCAUCCG UUUUAGAGCUAGAAAUAGCAA GUUAAAAUAAGGCUAGUCCGU UAUCAACUUGAAAAAGUGGCA CCGAGUCGGUGCUsususu | 386 | SpCas9 |
| hcPCSK9 | GA215 | CAGCGGCCGGGATGCCGGCG | 209 | csasgsCGGCCGGGAUGCCGGCGG UUUUAGAGCUAGAAAUAGCAA GUUAAAAUAAGGCUAGUCCGU UAUCAACUUGAAAAAGUGGCA CCGAGUCGGUGCUsususu | 387 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA216 | CCGGGATGCCGGCGTGGCCA | 210 | cscsgsGGAUGCCGGCGUGGCCAGUUUUAGAGCUAGAAAUAGCAAGUUAAAAUAAGGCUAGUCCGUUAUCAACUUGAAAAAGUGGCACCGAGUCGGUGCUsususu | 388 | SpCas9 |
| hcPCSK9 | GA217 | GTGGTCAGCGGCCGGGATGC | 211 | gsusgsGUCAGCGGCCGGGAUGCGUUUUAGAGCUAGAAAUAGCAAGUUAAAAUAAGGCUAGUCCGUUAUCAACUUGAAAAAGUGGCACCGAGUCGGUGCUsususu | 389 | SpCas9 |
| hcPCSK9 | GA218 | CGCTGACCACCCCTGCCAGG | 212 | csgscsUGACCACCCCUGCCAGGGUUUUAGAGCUAGAAAUAGCAAGUUAAAAUAAGGCUAGUCCGUUAUCAACUUGAAAAAGUGGCACCGAGUCGGUGCUsususu | 390 | SpCas9 |
| hcPCSK9 | GA219 | GGCAGGGGTGGTCAGCGGCC | 213 | gsgscsAGGGGUGGUCAGCGGCCGUUUUAGAGCUAGAAAUAGCAAGUUAAAAUAAGGCUAGUCCGUUAUCAACUUGAAAAAGUGGCACCGAGUCGGUGCUsususu | 391 | SpCas9 |
| hcPCSK9 | GA220 | GTGCTCAACTGCCAAGGGAA | 214 | gsusgsCUCAACUGCCAAGGGAAGUUUUAGAGCUAGAAAUAGCAAGUUAAAAUAAGGCUAGUCCGUUAUCAACUUGAAAAAGUGGCACCGAGUCGGUGCUsususu | 392 | SpCas9 |
| hPCSK9 | GA221 | TCATGGCACCCACCTGGCAG | 215 | uscsasUGGCACCCACCUGGCAGGUUUUAGAGCUAGAAAUAGCAAGUUAAAAUAAGGCUAGUCCGUUAUCAACUUGAAAAAGUGGCACCGAGUCGGUGCUsususu | 393 | SpCas9 |
| hcPCSK9 | GA222 | TGGCAGGGGTGGTCAGCGGC | 216 | usgsgsCAGGGGUGGUCAGCGGCGUUUUAGAGCUAGAAAUAGCAAGUUAAAAUAAGGCUAGUCCGUUAUCAACUUGAAAAAGUGGCACCGAGUCGGUGCUsususu | 394 | SpCas9 |
| hcPCSK9 | GA223 | GCTGACCACCCCTGCCAGGT | 217 | gscsusGACCACCCCUGCCAGGUGUUUUAGAGCUAGAAAUAGCAAGUUAAAAUAAGGCUAGUCCGUUAUCAACUUGAAAAAGUGGCACCGAGUCGGUGCUsususu | 395 | SpCas9 |
| hcPCSK9 | GA224 | GGCCGCTGACCACCCCTGCC | 218 | gsgscsCGCUGACCACCCCUGCCGUUUUAGAGCUAGAAAUAGCAAGUUAAAAUAAGGCUAGUCCGUUAUCAACUUGAAAAAGUGGCACCGAGUCGGUGCUsususu | 396 | SpCas9 |
| hcPCSK9 | GA225 | GGCATCGTCCCGGAAGTTGC | 219 | gsgscsAUCGUCCCGGAAGUUGCGUUUUAGAGCUAGAAAUAGCAAGUUAAAAUAAGGCUAGUCCGUUAUCAACUUGAAAAAGUGGCACCGAGUCGGUGCUsususu | 397 | SpCas9 |
| hcPCSK9 | GA226 | GGCTTTTCCGAATAAACTCC | 220 | gsgscsUUUUCCGAAUAAACUCCGUUUUAGAGCUAGAAAUAGCAAGUUAAAAUAAGGCUAGUCCGUUAUCAACUUGAAAAAGUGGCACCGAGUCGGUGCUsususu | 398 | SpCas9 |
| hcPCSK9 | GA227 | GTCCCGGAAGTTGCCGGCAG | 221 | gsuscsCCGGAAGUUGCCGGCAGGUUUUAGAGCUAGAAAUAGCAAGUUAAAAUAAGGCUAGUCCGUUAUCAACUUGAAAAAGUGGCACCGAGUCGGUGCUsususu | 399 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA228 | CGGCTGTACCCACCCGCCAG | 222 | csgsgsCUGUACCCACCCGCCAGGUUUUAGAGCUAGAAAUAGCAAGUUAAAAUAAGGCUAGUCCGUUAUCAACUUGAAAAAGUGGCACCGAGUCGGUGCUsususu | 400 | SpCas9 |
| hcPCSK9 | GA229 | GTCGTGCTGGTCACCGCTGC | 223 | gsuscsGUGCUGGUCACCGCUGCGUUUUAGAGCUAGAAAUAGCAAGUUAAAAUAAGGCUAGUCCGUUAUCAACUUGAAAAAGUGGCACCGAGUCGGUGCUsususu | 401 | SpCas9 |
| hcPCSK9 | GA230 | AGTAGAGGCAGGCATCGTCC | 224 | asgsusAGAGGCAGGCAUCGUCCGUUUUAGAGCUAGAAAUAGCAAGUUAAAAUAAGGCUAGUCCGUUAUCAACUUGAAAAAGUGGCACCGAGUCGGUGCUsususu | 402 | SpCas9 |
| hcPCSK9 | GA231 | TCCGAATAAACTCCAGGCCT | 225 | uscscsGAAUAAACUCCAGGCCUGUUUUAGAGCUAGAAAUAGCAAGUUAAAAUAAGGCUAGUCCGUUAUCAACUUGAAAAAGUGGCACCGAGUCGGUGCUsususu | 403 | SpCas9 |
| hcPCSK9 | GA232 | GTTTATTCGGAAAAGCCAGC | 226 | gsusUAUUCGGAAAAGCCAGCGUUUUAGAGCUAGAAAUAGCAAGUUAAAAUAAGGCUAGUCCGUUAUCAACUUGAAAAAGUGGCACCGAGUCGGUGCUsususu | 404 | SpCas9 |
| hPCSK9 | GA233 | GCGGCTGTACCCACCCGCCA | 227 | gscsgsGCUGUACCCACCCGCCAGUUUUAGAGCUAGAAAUAGCAAGUUAAAAUAAGGCUAGUCCGUUAUCAACUUGAAAAAGUGGCACCGAGUCGGUGCUsususu | 405 | SpCas9 |
| hcPCSK9 | GA235 | CACCGCTGCCGGCAACTTCC | 228 | csascsCGCUGCCGGCAACUUCCGUUUUAGAGCUAGAAAUAGCAAGUUAAAAUAAGGCUAGUCCGUUAUCAACUUGAAAAAGUGGCACCGAGUCGGUGCUsususu | 406 | SpCas9 |
| hcPCSK9 | GA236 | AGCCCTCGCCAGGCGCTGGC | 229 | asgscsCCUCGCCAGGCGCUGGCGUUUUAGAGCUAGAAAUAGCAAGUUAAAAUAAGGCUAGUCCGUUAUCAACUUGAAAAAGUGGCACCGAGUCGGUGCUsususu | 407 | SpCas9 |
| hcPCSK9 | GA237 | CAACGCCGCCTGCCAGCGCC | 230 | csasasCGCCGCCUGCCAGCGCCGUUUUAGAGCUAGAAAUAGCAAGUUAAAAUAAGGCUAGUCCGUUAUCAACUUGAAAAAGUGGCACCGAGUCGGUGCUsususu | 408 | SpCas9 |
| hcPCSK9 | GA238 | GCACGACCCCAGCCCTCGCC | 231 | gscsasCGACCCCAGCCCUCGCCGUUUUAGAGCUAGAAAUAGCAAGUUAAAAUAAGGCUAGUCCGUUAUCAACUUGAAAAAGUGGCACCGAGUCGGUGCUsususu | 409 | SpCas9 |
| hcPCSK9 | GA239 | CCGCCTGCCAGCGCCTGGCG | 232 | cscsgsCCUGCCAGCGCCUGGCGGUUUUAGAGCUAGAAAUAGCAAGUUAAAAUAAGGCUAGUCCGUUAUCAACUUGAAAAAGUGGCACCGAGUCGGUGCUsususu | 410 | SpCas9 |
| hcPCSK9 | GA240 | TGCCAGCGCCTGGCGAGGGC | 233 | usgscsCAGCGCCUGGCGAGGGCGUUUUAGAGCUAGAAAUAGCAAGUUAAAAUAAGGCUAGUCCGUUAUCAACUUGAAAAAGUGGCACCGAGUCGGUGCUsususu | 411 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA241 | TGCTGCTGCCCCTGGCGGGT | 234 | usgscsUGCUGCCCCUGGCGGGUG UUUUAGAGCUAGAAAUAGCAA GUUAAAAUAAGGCUAGUCCGU UAUCAACUUGAAAAAGUGGCA CCGAGUCGGUGCUsususu | 412 | SpCas9 |
| hcPCSK9 | GA242 | TCACCGCTGCCGGCAACTTC | 235 | uscsasCCGCUGCCGGCAACUUCG UUUUAGAGCUAGAAAUAGCAA GUUAAAAUAAGGCUAGUCCGU UAUCAACUUGAAAAAGUGGCA CCGAGUCGGUGCUsususu | 413 | SpCas9 |
| hcPCSK9 | GA243 | GGCGAGGGCTGGGGTCGTGC | 236 | gsgscsGAGGGCUGGGGUCGUGC GUUUUAGAGCUAGAAAUAGCA AGUUAAAAUAAGGCUAGUCCG UUAUCAACUUGAAAAAGUGGC ACCGAGUCGGUGCUsususu | 414 | SpCas9 |
| hcPCSK9 | GA244 | TTCCGAATAAACTCCAGGCC | 237 | ususcsCGAAUAAACUCCAGGCCG UUUUAGAGCUAGAAAUAGCAA GUUAAAAUAAGGCUAGUCCGU UAUCAACUUGAAAAAGUGGCA CCGAGUCGGUGCUsususu | 415 | SpCas9 |
| hcPCSK9 | GA245 | GTGCTGCTGCCCCTGGCGGG | 238 | gsusgsCUGCUGCCCCUGGCGGGG UUUUAGAGCUAGAAAUAGCAA GUUAAAAUAAGGCUAGUCCGU UAUCAACUUGAAAAAGUGGCA CCGAGUCGGUGCUsususu | 416 | SpCas9 |
| hcPCSK9 | GA246 | GCCAGCGCCTGGCGAGGGCT | 239 | gscscsAGCGCCUGGCGAGGGCUG UUUUAGAGCUAGAAAUAGCAA GUUAAAAUAAGGCUAGUCCGU UAUCAACUUGAAAAAGUGGCA CCGAGUCGGUGCUsususu | 417 | SpCas9 |
| hcPCSK9 | GA247 | CCTCGCCAGGCGCTGGCAGG | 240 | cscsusCGCCAGGCGCUGGCAGGG UUUUAGAGCUAGAAAUAGCAA GUUAAAAUAAGGCUAGUCCGU UAUCAACUUGAAAAAGUGGCA CCGAGUCGGUGCUsususu | 418 | SpCas9 |
| hcPCSK9 | GA248 | GGTGCTAGCCTTGCGTTCCG | 66 | gsgsusG(cPACE)UAGCCUUGCGU UCCGGUUUUAGAgcuagaaauagcA AGUUAAAAUAAGGCUAGUCCG UUAUCAacuugaaaaaguggcaccgaguc ggugcusususu | 419 | SpCas9 |
| hcPCSK9 | GA249 | GGTGCTAGCCTTGCGTTCCG | 66 | gsgsusGCUAGCC(uPACE)UGCGU UCCGGUUUUAGAgcuagaaauagcA AGUUAAAAUAAGGCUAGUCCG UUAUCAacuugaaaaaguggcaccgaguc ggugcusususu | 420 | SpCas9 |
| hcPCSK9 | GA250 | GGTGCTAGCCTTGCGTTCCG | 66 | gsgsusGcUAGCCUUGCGUUCCGG UUUUAGAgcuagaaauagcAAGUUA AAAUAAGGCUAGUCCGUUAUC Aacuugaaaaaguggcaccgagucggugcusu susu | 253 | SpCas9 |
| hcPCSK9 | GA251 | GGTGCTAGCCTTGCGTTCCG | 66 | gsgsusGCUAGCCuUGCGUUCCGG UUUUAGAgcuagaaauagcAAGUUA AAAUAAGGCUAGUCCGUUAUC Aacuugaaaaaguggcaccgagucggugcusu susu | 253 | SpCas9 |
| hcPCSK9 | GA253 | GGTGCTAGCCTTGCGTTCCG | 66 | gsgsusG(cPACE)UAGCCUUGCGU UCCGgUUUUAGAgcuagaaauagcaaG UUaAaAuAaggcuaGUccGUUAucA Acuugaaaaagugcaccgagucggugcusu susu | 419 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA254 | GGTGCTAGCCTTGCGTTCCG | 66 | gsgsusGCUAGCC(uPACE)UGCGU UCCGgUUUUAGagcuagaaauagcaaG UUaAaAuAaggcuaGUccGUUAucA AcuugaaaaagugGcaccgagucggugcusu susu | 420 | SpCas9 |
| mPCSK9 | GA255 | CCCATACCTTGGAGCAACGG | 69 | cscscsAUACCUUGGAGCAACGGg UUUUAGagcuaGaaauagcaaGUUaAa AuAaggCUaGUCcGUUAucAAcuuG aaaaaguGgcaccgAgUCggugcusususu | 421 | ABE |
| mPCSK9 | GA256 | CCCATACCTTGGAGCAACGG | 69 | cscscsAUACCUUGGAGCAACGGg UUUUAGagcuagaaauagcaaGUUaAa AuAaggcuaGUccGUUAucAAcuugaa aaagugGcaccgagucggugcusususu | 421 | ABE |
| mPCSK9 | GA257 | CCCATACCTTGGAGCAACGG | 69 | cscscsAUACCUUGGAGCAACGGg UUUUAGagcuaGaaauagcaaGUUaAa AuAaggcuaGUccGUUAucAAcuuGa aaaagugGcaccgagucggugcusususu | 421 | ABE |
| mANGPTL3 | GA258 | GAGATACCTGAGTAACTTTC | 241 | gsasgsAUACCUGAGUAACUUUCg UUUUAGagcuaGaaauagcaaGUUaAa AuAaggCUaGUCcGUUAucAAcuuG aaaaaguGgcaccgAgUCggugcusususu | 422 | ABE |
| mANGPTL3 | GA259 | GAGATACCTGAGTAACTTTC | 241 | gsasgsAUACCUGAGUAACUUUCg UUUUAGagcuagaaauagcaaGUUaAa AuAaggcuaGUccGUUAucAAcuugaa aaagugGcaccgagucggugcusususu | 422 | ABE |
| mANGPTL3 | GA260 | GAGATACCTGAGTAACTTTC | 241 | gsasgsAUACCUGAGUAACUUUCg UUUUAGagcuaGaaauagcaaGUUaAa AuAaggcuaGUccGUUAucAAcuuGa aaaagugGcaccgagucggugcusususu | 422 | ABE |
| hcANGPTL3 | GA276 | ACGTGGGAGAACTACAAATA | 242 | ascsgsUGGGAGAACUACAAAUA GUUUUAGAGCUAGAAAUAGCA AGUUAAAAUAAGGCUAGUCCG UUAUCAACUUGAAAAAGUGGC ACCGAGUCGGUGCUsususu | 423 | ABE |
| hcANGPTL3 | GA277 | CGATGTTGAATTAATGTCCA | 243 | csgsasUGUUGAAUUAAUGUCCA GUUUUAGAGCUAGAAAUAGCA AGUUAAAAUAAGGCUAGUCCG UUAUCAACUUGAAAAAGUGGC ACCGAGUCGGUGCUsususu | 424 | ABE |
| hcANGPTL3 | GA278 | CACAAAACTTCAATGAAACG | 244 | csascsAAAACUUCAAUGAAACGG UUUUAGAGCUAGAAAUAGCAA GUUAAAAUAAGGCUAGUCCGU UAUCAACUUGAAAAAGUGGCA CCGAGUCGGUGCUsususu | 425 | ABE |
| hcANGPTL3 | GA279 | TACGAATTGAGTTGGAAGAC | 245 | usascsGAAUUGAGUUGGAAGAC GUUUUAGAGCUAGAAAUAGCA AGUUAAAAUAAGGCUAGUCCG UUAUCAACUUGAAAAAGUGGC ACCGAGUCGGUGCUsususu | 426 | ABE |
| hcANGPTL3 | GA284 | CTATGGAGTATATCTTCTCT | 246 | csusasUGGAGUAUAUCUUCUCU GUUUUAGAGCUAGAAAUAGCA AGUUAAAAUAAGGCUAGUCCG UUAUCAACUUGAAAAAGUGGC ACCGAGUCGGUGCUsususu | 427 | ABE |
| hcPCSK9 | GA343 | CCCGCACCTTGGCGCAGCGG | 13 | cscscsGCACCUUGGCGCAGCGGG UUUUAGAGCUAGAAAUAGCAA GUUAAAAUAAGGCUAGUCCGU UAUCAACUUGAAAAAGUGGCA CCGAGUCGGUGCUsususu | 9 | ABE |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | Editor SEQ ID NO | associated data |
|---|---|---|---|---|---|---|
| cANGPTL3 | GA344 | AAGATACCTGAATAACTCTC | 14 | asasgsAUACCUGAAUAACUCUCG UUUUAGAGCUAGAAAUAGCAA GUUAAAAUAAGGCUAGUCCGU UAUCAACUUGAAAAAGUGGCA CCGAGUCGGUGCUsususu | 257 | ABE |
| hcPCSK9 | GA346 | CCCGCACCTTGGCGCAGCGG | 13 | cscscsGCACCUUGGCGCAGCGGg UUUUAGagcuaGaaauagcaaGUUaAa AuAaggcuaGUccGUUAucAAcuuGa aaaagugGcaccgagucggugcusususu | 9 | ABE |
| cANGPTL3 | GA347 | AAGATACCTGAATAACTCTC | 14 | asasgsAUACCUGAAUAACUCUCg UUUUAGagcuaGaaauagcaaGUUaAa AuAaggcuaGUccGUUAucAAcuuGa aaaagugGcaccgagucggugcusususu | 257 | ABE |
| mANGPTL3 | GA349 | GAGATACCTGAGTAACTTTC | 241 | gsasgsAUACCUGAGUAACUUUC GUUUUAGAgcuagaaauagcAAGUU AAAAUAAGGCUAGUCCGUUAU CAacuugaaaaaguggcaccgagucggugcu sususu | 422 | ABE |
| mANGPTL3 | GA353 | GAGATACCTGAGTAACTTTC | 241 | gsasgsAUACCUGAGUAACUUUC GUUUUAGAGCUAGAAAUAGCA AGUUAAAAUAAGGCUAGUCCG UUAUCAACUUGAAAAAGUGGC ACCGAGUCGGUGCUsususu | 422 | ABE |
| hcPCSK9 | GA375 | CCCGCACCTTGGCGCAGCGG | 13 | cscscsGCACCUUGGCGCAGCGGg UUUUAGagcuaGaaauagcaaGUUaAa AuAaggcuaGUccGUUAacAAcgggaa accgugGcaccgagucggugcusususu | 428 | ABE |
| hcPCSK9 | GA376 | CCCGCACCTTGGCGCAGCGG | 13 | cscscsdGdCdACdCdUdUGdGdCdGdCdA GdCdGdGgUUUUAGagcuaGaaauagc aaGUUaAaAuAaggcuaGUccGUUAu cAAcuuGaaaaagugGcaccgagucggugc ususus | 429 | ABE |
| hcPCSK9 | GA377 | CCCGCACCTTGGCGCAGCGG | 13 | cscscsGdCAdCCdUUdGGdCdGdCdAd GCdGGgUUUUAGagcuaGaaauagcaa GUUaAaAuAaggcuaGUccGUUAuc AAcuuGaaaaagugGcaccgagucggugcu sususu | 430 | ABE |
| hcPCSK9 | GA380 | CCCGCACCTTGGCGCAGCGG | 13 | cscscsGdCACCUUGGCGdCAGCG GgUUUUAGagcuaGaaauagcaaGUUa AaAuAaggcuaGUccGUUAucAAcuu Gaaaaagugcaccgagucggugcusususu | 431 | ABE |
| hcPCSK9 | GA381 | CCCGCACCTTGGCGCAGCGG | 13 | cscscsGCdACCUUGGCGCdAGCG GgUUUUAGagcuaGaaauagcaaGUUa AaAuAaggcuaGUccGUUAucAAcuu Gaaaaagugcaccgagucggugcusususu | 432 | ABE |
| hcPCSK9 | GA382 | CCCGCACCTTGGCGCAGCGG | 13 | cscscsGCACCUdUGGdCGCAGdCG GgUUUUAGagcuaGaaauagcaaGUUa AaAuAaggcuaGUccGUUAucAAcuu Gaaaaagugcaccgagucggugcusususu | 433 | ABE |
| hcPCSK9 | GA383 | CCCGCACCTTGGCGCAGCGG | 13 | cscscsGCACCUUdGGCdGCAGCdG GgUUUUAGagcuaGaaauagcaaGUUa AaAuAaggcuaGUccGUUAucAAcuu Gaaaaagugcaccgagucggugcusususu | 434 | ABE |
| hcPCSK9 | GA384 | CCCGCACCTTGGCGCAGCGG | 13 | cscscsdGdCdACCdUdUGGdCGCAd GCdGdGgUUUUAGagcuaGaaauagcaa GUUaAaAuAaggcuaGUccGUUAuc AAcuuGaaaaagugGcaccgagucggugcu sususu | 435 | ABE |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcPCSK9 | GA385 | CCCGCACCTTGGCGCAGCGG | 13 | cscscsGCACCUUGGCGCAGCGGgUUUUAGagcuagaaauagcaaGUUaAaAuAaggcuaGUccGUUAucAAcuugaaaaagugGcaccgagucggugcususususuuuu | 11 | ABE |
| hcPCSK9 | GA386 | CCCGCACCTTGGCGCAGCGG | 13 | cscscsGCACCUUGGCGCAGCGGgUUUUAGagcuagaaauagcaaGUUaAaAuAaggcuaGUccGUUAucAAcuugaaaaagugGcaccgagucggugcususususuuUu | 11 | ABE |
| hcPCSK9 | GA387 | CCCGCACCTTGGCGCAGCGG | 13 | cscscsGCACCUUGGCGCAGCGgUUUUAGagcuaGaaauagcaaGUUaAaAuAaggcuaGUccGUUAucAAcuuGaaaagugGcaccgagucggugcuusususuuuu | 436 | ABE |
| hcPCSK9 | GA388 | CCCGCACCTTGGCGCAGCGG | 13 | cscscsGCACCUUGGCGCAGCGGgUUUUAGagcuagaaauagcaaGUUaAaAuAaggcuaGUccGUUAucAAcuugaaaagugGcaccgagucggugcususususu | 9 | ABE |
| hcPCSK9 | GA389 | CCCGCACCTTGGCGCAGCGG | 13 | cscscsGCACCUUGGCGCAGCGGgUUUUAGagcuagaaauagcaaGUUaAaAuAaggcuaGUcCGUUAucAAcuugaaaagugGcaccgagucggugcususususu | 9 | ABE |
| hcPCSK9 | GA391 | CCGCACCTTGGCGCAGCGG | 247 | cscsGCACCUUGGCGCAGCGGgUUUUAGagcuaGaaauagcaaGUUaAaAuAaggcuaGUccGUUAucAAcuuGaaaagugGcaccgagucggugcususususu | 437 | ABE |
| hANGPTL3 | GA441 | AAGATACCTGAATAACCCTC | 15 | asasgsAUACCUGAAUAACCCUCgUUUUAGagcuaGaaauagcaaGUUaAaAuAaggcuaGUccGUUAucAAcuuGaaaagugGcaccgagucggugcususususu | 59 | ABE |
| hANGPTL3 | GA442 | AAGATACCTGAATAACCCTC | 15 | asasgsAUACCUGAAUAACCCUCgUUUUAGagcuaGaaauagcaaGUUaAaAuAaggcuaGUccGUUAucAAcuuGaaaaagugGcaccgagucggugcusususuUUu | 438 | ABE |
| hANGPTL3 | GA472 | AAGATACCTGAATAACCCTC | 15 | asasisAUACCUGAAUAACCCUCgUUUUAGagcuaGaaauagcaaGUUaAaAuAaggcuaGUccGUUAucAAcuuGaaaagugGcaccgagucggugcususususu | 439 | ABE |
| hANGPTL3 | GA473 | AAGATACCTGAATAACCCTC | 15 | asasisAUACCUIAAUAACCCUCgUUUUUAGagcuaGaaauagcaaGUUaAaAuAaggcuaGUccGUUAucAAcuuGaaaagugGcaccgagucggugcususususu | 440 | ABE |
| hANGPTL3 | GA474 | AAGATACCTGAATAACCCTC | 15 | asasgsAUACCUIAAUAACCCUCgUUUUUAGagcuaGaaauagcaaGUUaAaAuAaggcuaGUccGUUAucAAcuuGaaaagugGcaccgagucggugcususususu | 441 | ABE |
| hANGPTL3 | GA475 | AGATACCTGAATAACCCTC | 248 | asgsasUACCUGAAUAACCCUCgUUUUUAGagcuaGaaauagcaaGUUaAaAuAaggcuaGUccGUUAucAAcuuGaaaagugGcaccgagucggugcususususu | 442 | ABE |
| hANGPTL3 | GA476 | GATACCTGAATAACCCTC | 249 | gsasUACCUGAAUAACCCUCgUUUUAGagcuaGaaauagcaaGUUaAaAuAaggcuaGUccGUUAucAAcuuGaaaaagugGcaccgagucggugcususususu | 443 | ABE |
| hANGPTL3 | GA477 | ATACCTGAATAACCCTC | 250 | asusACCUGAAUAACCCUCgUUUUAGagcuaGaaauagcaaGUUaAaAuAaggcuaGUccGUUAucAAcuuGaaaaagugGcaccgagucggugcususususu | 444 | ABE |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hANGPTL3 | GA547 | AAGATACCTGAATAACTCTC | 14 | asasgsAUACCUGAAUAACUCUCgUUUUAGagcuaGaaauagcaaGUUaAaAuAaggcuaGUccGUUAucAAcuuGaaaaagugggcaccgagucggugcususususuUUu | 445 | ABE |
| mPCSK9 | GA010 | GGCTGATGAGGCCGCACATG | 251 | 5'gsgscsUGAUGAGGCCGCACAUGGUUUUAGAgcuagaaauagcAAGUUAAAAUAAGGCUAGUCCGUUAUCAacuugaaaaaguggcaccgagucggugcusususu-3' | 446 | SpCas9 |
| mPCSK9 | GA011 | GGCTGATGAGGCCGCACATG | 251 | 5'gsgscsUGAUGAGGCCGCACAUGGUUUUAGAgcuagaaauagcAAGUUAAAAUAAGGCUAGUCCGUUAUCAacuugaaaaaguggcaccgagucggugcusususu-3' | 446 | SpCas9 |
| hcANGPTL3 | GA016 | GGCCTCCTTCAGTTGGGACA | 107 | 5'gsgscsCUCCUUCAGUUGGGACAGUUUUAGAgcuagaaauagcAAGUUAAAAUAAGGCUAGUCCGUUAUCAacuugaaaaaguggcaccgagucggugcusususu-3' | 285 | SpCas9 |
| hcANGPTL3 | GA017 | GCCAATGGCCTCCTTCAGTT | 109 | 5'gscscsAAUGGCCUCCUUCAGUUGUUUUAGAgcuagaaauagcAAGUUAAAAUAAGGCUAGUCCGUUAUCAacuugaaaaaguggcaccgagucggugcusususu-3' | 287 | SpCas9 |
| hcPCSK9 | GA395 | TCAGCTCCAGGCGGTCCTGG | 161 | 5'uscsasGCUCCAGGCGGUCCUGGgUUUUAGagcuaGaaauagcaaGUUaAaAuAaggcuaGUccGUUAucAAcuuGu-3' | 447 | SpCas9 |
| hcPCSK9 | GA396 | TCAGCTCCAGGCGGTCCTGG | 161 | 5'uscsasGCUCCAGGCGGUCCUGGgUUUUAGagcuaGaaauagcaaGUUsaAaAuAaggcuaGUccGUUAucAAcuuGaaaaagugGcaccgagucggugcusususuuuu-3' | 448 | SpCas9 |
| hcPCSK9 | GA397 | TCAGCTCCAGGCGGTCCTGG | 161 | 5'uscsasGCUCCAGGCGGUCCUGGgUUUUAGagcuaGaaauagcaaGUUaAaAuAaggcuaGUccGUUsAucAAcuuGaaaaagugGcaccgagucggugcusususuuuu-3' | 449 | SpCas9 |
| hcPCSK9 | GA398 | TCAGCTCCAGGCGGTCCTGG | 161 | 5'uscsasGCUCCAGGCGGUCCUGGgUUUUAGagcuagaaauagcaaGUUaAaAuAaggcuaGUCcGUUAucAAcuugaaaaaguggcaccgagucggugcusususuuuu-3' | 447 | SpCas9 |
| hcPCSK9 | GA399 | TCAGCTCCAGGCGGTCCTGG | 161 | 5'uscsasGCUCCAGGCGGUCCUGGgUUUUAGagcuagaaauagcaaGUUaAaAuAaggcuaGuCcGUUaucAAcuuga-3' | 447 | SpCas9 |
| hcPCSK9 | GA400 | TCAGCTCCAGGCGGTCCTGG | 161 | 5'uscsasGCUCCAGGCGGUCCUGGgUUUuagagcuagaaauagcaaGUUaAaAuaaggcuaGuccgUUaucaacuugaaaaaguggcaccgagucggugcusususuuuu-3' | 447 | SpCas9 |
| hcPCSK9 | GA401 | TCAGCTCCAGGCGGTCCTGG | 161 | 5'uscsasGCUCCAGGCGGUCCUGGgUUUUAGagcuagaaauagcaaGUUaAaAuAaggcuaGUccGUUAucAAcuuga-3' | 447 | SpCas9 |
| hcPCSK9 | GA402 | TCAGCTCCAGGCGGTCCTGG | 161 | 5'uscsasGCUCCAGGCGGUCCUGGgUUUUAGagcuaGaaauagcaaGUUaAaAuAaggcuaGUccGUUAucAAcuuGaaaaagugGcaccgagucggugcusususuu | 447 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| | | | | Uu-3' | | |
| hcPCSK9 | GA403 | TCAGCTCCAGGCGGTCCTGG | 161 | 5'uscsasGCUCCAGGCGGUCCUGG gUUUUAGagcuaGaaauagcaaGUUsa AaAuAaggcuaGUccGUUAucAAcuu GaaaaagugGcaccgagucggugcusususu uUu-3' | 448 | SpCas9 |
| hcPCSK9 | GA404 | TCAGCTCCAGGCGGTCCTGG | 161 | 5'uscsasGCUCCAGGCGGUCCUGG gUUUUAGagcuaGaaauagcaaGUUaA aAuAaggcuaGUccGUUsAucAAcuu GaaaaagugGcaccgagucggugcusususu uUu-3' | 449 | SpCas9 |
| hcPCSK9 | GA405 | TCAGCTCCAGGCGGTCCTGG | 161 | 5'uscsasGCUCCAGGCGGUCCUGG gUUUUAGagcuagaaauagcaaGUUaA aAuAaggcuaGUCcGUUAucAAcuug aaaaaguggcaccgagucggugcusususuuU u-3' | 447 | SpCas9 |
| hcPCSK9 | GA406 | TCAGCTCCAGGCGGTCCTGG | 161 | 5'uscsasGCUCCAGGCGGUCCUGG gUUUUAGagcuagaaauagcaaGUUaA aAuAaggcuaGuCcGUUaucAAcuuga aaaaguggcaccgagucggugcusususuuUu-3' | 447 | SpCas9 |
| hcPCSK9 | GA407 | TCAGCTCCAGGCGGTCCTGG | 161 | 5'uscsasGCUCCAGGCGGUCCUGG gUUUuagagcuagaaauagcaaGUUaAa AuaaggcuaGuccgUUauccaacuugaaaaa guggcaccgagucggugcusususuuUu-3' | 447 | SpCas9 |
| hcPCSK9 | GA408 | TCAGCTCCAGGCGGTCCTGG | 161 | 5'uscsasGCUCCAGGCGGUCCUGG gUUUUAGagcuagaaauagcaaGUUaA aAuAaggcuaGUccGUUAucAAcuuga aaaaagugGcaccgagucggugcusususuuU u-3' | 447 | SpCas9 |
| hcPCSK9 | GA409 | TCAGCTCCAGGCGGTCCTGG | 161 | 5'uscsasG(C-PACE)UCCAGGCGGUCCUGGgU UUUAGagcuagaaauagcaaGUUaAaA uAaggcuaGUccGUUAucAAcuugaaa aagugGcaccgagucggugcusususu-3' | 450 | SpCas9 |
| hcPCSK9 | GA410 | TCAGCTCCAGGCGGTCCTGG | 161 | 5'uscsasGCUCCAG(G-PACE)CGGUCCUGGgUUUUAGag cuagaaauagcaaGUUaAaAuAaggcuaG UccGUUAucAAcuugaaaaagugGcacc gagucggugcusususu-3' | 451 | SpCas9 |
| hcPCSK9 | GA439 | CCCGCACCTTGGCGCAGCGG | 13 | 5'cscscsGCACCUUGGCGCAGCGG gUUUUAGagcuaGaaauagcaaGUUaA aAuAaggcuaGUccGUUAucAAcuuG aaaaagugGcaccgagucggugcusususuU Uu-3' | 11 | ABE |
| hcPCSK9 | GA440 | CCCGCACCTTGGCGCAGCGG | 13 | 5'cscscsGCACCUUGGCGCAGCGG gUUUUAGagcuagaaauagcaaGUUaA aAuAaggcuaGUccGUUAucAAcuuga aaaaagugGcaccgagucggugcusususuUU u-3' | 11 | ABE |
| hcPCSK9 | GA234 | CGCCTGCCAGCGCCTGGCGA | 252 | csgscsCUGCCAGCGCCUGGCGAG UUUUAGAGCUAGAAAUAGCAA GUUAAAAUAAGGCUAGUCCGU UAUCAACUUGAAAAAGUGGCA CCGAGUCGGUGCUsususu | 452 | SpCas9 |
| hcANGPTL3 | GA261 | TGAAGAAAGGGAGTAGTTCT | 126 | 5'usgsasAGAAAGGGAGUAGUUC UgUUUUAGagcuagaaauagcaaGUUa AaAuAaggcuaGUccGUUAucAAcuu gaaaaagugGcaccgagucggugcusususu-3' | 304 | SpCas9 |

TABLE 1-continued

Guide RNAs (SgRNA/gRNA) for Cas9 nuclease and ABE editors

| Gene Target | gRNA ID | Protospacer (5'-3') | SEQ ID NO | Sequence (5'-3') | SEQ ID NO | Editor associated data |
|---|---|---|---|---|---|---|
| hcAN GPTL3 | GA262 | CATTATAT TCAGGTAG TCCA | 143 | 5'csasusUAUAUUCAGGUAGUCC AgUUUUAGagcuagaaauagcaaGUUa AaAuAaggcuaGUccGUUAucAAcuu gaaaaagugGcaccgagucggugcusususu-3' | 321 | SpCas9 |
| hcAN GPTL3 | GA263 | ACAAAACT TCAATGAA ACGT | 146 | 5'ascsasAAACUUCAAUGAAACG UgUUUUAGagcuagaaauagcaaGUUa AaAuAaggcuaGUccGUUAucAAcuu gaaaaagugGcaccgagucggugcusususu-3' | 324 | SpCas9 |
| hcAN GPTL3 | GA264 | GCCAATGG CCTCCTTC AGTT | 109 | 5'gscscsAAUGGCCUCCUUCAGU UgUUUUAGagcuagaaauagcaaGUUa AaAuAaggcuaGUccGUUAucAAcuu gaaaaagugGcaccgagucggugcusususu-3' | 287 | SpCas9 |
| hcAN GPTL3 | GA265 | GCCAATGG CCTCCTTC AGTT | 109 | 5'gscscsAAUGGCCUCCUUCAGU UgUUUUAGagcuaGaaauagcaaGUUa AaAuAaggcUaGUCcGUUAucAAcu uGaaaaaguGgcaccgAgUCggugcususu su-3' | 287 | SpCas9 |
| hcPCS K9 | GA266 | TCAGCTCC AGGCGGTC CTGG | 161 | 5'uscsasGCUCCAGGCGGUCCUGG gUUUUAGagcuagaaauagcaaGUUaA aAuAaggcuaGUccGUUAucAAcuuga aaaagugGcaccgagucggugcusususu-3' | 339 | SpCas9 |
| hcPCS K9 | GA267 | GCCCCATG TCGACTAC ATCG | 185 | 5'gscscsCCAUGUCGACUACAUCG gUUUUAGagcuagaaauagcaaGUUaA aAuAaggcuaGUccGUUAucAAcuuga aaaagugGcaccgagucggugcusususu-3' | 363 | SpCas9 |
| hcPCS K9 | GA268 | GGGGCTG GTATTCAT CCGCC | 187 | 5'gsgsgsGCUGGUAUUCAUCCGC CgUUUUAGagcuagaaauagcaaGUUa AaAuAaggcuaGUccGUUAucAAcuu gaaaaagugGcaccgagucggugcusususu-3' | 365 | SpCas9 |
| hcPCS K9 | GA269 | CTAGGAG ATACACCT CCACC | 194 | 5'csusasGGAGAUACACCUCCACC gUUUUAGagcuagaaauagcaaGUUaA aAuAaggcuaGUccGUUAucAAcuuga aaaagugGcaccgagucggugcusususu-3' | 372 | SpCas9 |
| hcPCS K9 | GA270 | CTGCGCGT GCTCAACT GCCA | 204 | 5'csusgsCGCGUGCUCAACUGCCA gUUUUAGagcuagaaauagcaaGUUaA aAuAaggcuaGUccGUUAucAAcuuga aaaagugGcaccgagucggugcusususu-3' | 382 | SpCas9 |
| hcPCS K9 | GA271 | CGGGATGC CGGCGTGG CCAA | 206 | 5'csgsgsGAUGCCGGCGUGGCCA AgUUUUAGagcuagaaauagcaaGUUa AaAuAaggcuaGUccGUUAucAAcuu gaaaaagugGcaccgagucggugcusususu-3' | 384 | SpCas9 |
| hcPCS K9 | GA272 | CGCTGACC ACCCCTGC CAGG | 212 | 5'csgscsUGACCACCCCUGCCAGG gUUUUAGagcuagaaauagcaaGUUaA aAuAaggcuaGUccGUUAucAAcuuga aaaagugGcaccgagucggugcusususu-3' | 390 | SpCas9 |
| mPCS K9 | GA292 | cccatacCTTG GAGCAAC GG | 69 | 5'cscscsAUACCUUGGAGCAACG GGUUUUAGAGCUAGAAAUAGC AAGUUAAAAUAAGGCUAGUCC GUUAUCAACUUGAAAAAGUGG CACCGAGUCGGUGCUsususu-3' | 421 | ABE |

As used in Table 1 above, Table 23, and Table 24, in the Protospacer: uppercase nucleotides (A, G, C, I and T) indicate 2'-deoxyribonucleotides, adenine, guanine, cytosine, inosine, and thymine, respectively; in Guide RNA sequence: uppercase nucleotides (A, C, G, I and U) indicate ribonucleotides, adenine, guanine, cytosine, inosine, and uracil, respectively and lowercase nucleotides (a, g, c, i and u) indicate 2'-O-methylribonucleotide (2'-OMe) unless otherwise specified. It is understood that the DNA protospacer is converted to RNA or RNA-equivalent in the guide RNA design except when other modifications including 2'-deoxyribonucleotides are introduced into the spacer section of the single guide RNA; s: phosphorothioate (PS), X=ribonebularine; x=2'-O-methylnebularine; dX=2'-deoxynebularine; 5'-NNN-3' indicates uniform A, C, G, I, U, dA, dG, dC, dI, T, X, x, dX, and combinations thereof. 5'-nnn-3' indicates uniform a, c, g, i, u, dA, dG, dC or T, x, dX, and combinations thereof. mANGPTL3: mouse ANGPTL3; hANGPTL3: human ANGPTL3; cANGPTL3: cynomolgus ANGPTL3; mcANGPTL3: mouse, cynomolgus cross-reactive ANGPTL3; hcANGPTL3: human, cynomolgus cross-reactive ANGPTL3; mPCSK9: mouse PCSK9; hPCSK9: human PCSK9; cPCSK9: cynomolgus PCSK9; mcPCSK9: mouse, cynomolgus cross-reactive PCSK9; hcPCSK9: human, cynomolgus cross-reactive PCSK9; hcAPOC3: human, cynomolgus cross-reactive APOC3. As disclosed herein, the nucleotide sequences and modification patterns encompass all length, structure, and type of RNAs or fragments thereof, CRISPR guide RNAs, e.g. sgRNAs, dual guide RNAs, or mRNAs. For example, nucleotide sequences and modification patterns as described in the Table above may indicate RNA sequences and modification patterns in a single guide RNA, a dual guide RNA, a nuclease mRNA, or any fragment or segment thereof. In Table 23, u' indicates $N^1$-methylpseudouridine.

Example 2. PCSK9 and ANGPTL3 Cas9 Editing In Vitro

In set of experiments, PCSK9 gRNAs were co-transfected with an equivalent amount (1:1 ratio by weight) of in vitro transcribed commercially available SpCas9 mRNA MS002 purchased from TriLink Biotechnologies into primary human hepatocytes at 2500, 500, or 100 ng/RNA/mL and processed as described in detailed methods. Extracted genomic DNA was analyzed for gene editing at the target site with next-generation sequencing of PCR amplicons generated around the target sites. Samples were prepared using the Nextera XT DNA library preparation kit (Illumina) according to the manufacturer's protocol. Briefly, two rounds of PCR were performed first to amplify the region of interest and second to add DNA sequences required for next generation sequencing and sample identification to the initial product. The final amplicon was sequenced on the Illumina MiSeq instrument according to the manufacturer's protocol. A wide range of editing activities (Table 2) were observed. In a second set of experiments, ANGPTL3 gRNAs were co-transfected with an equivalent amount of in vitro transcribed SpCas9 mRNA (1:1 ratio by weight) into primary human hepatocytes and processed and analyzed similarly (Table 3).

TABLE 2

PCSK9 gRNA/SpCas9 editing in primary hepatocytes

| gRNA | Protospacer (5'-3') | SEQ ID NO: | Human Primary Hepatocyte Editing % | | | Cyno Primary Hepatocyte Editing % | | |
|---|---|---|---|---|---|---|---|---|
| | | | 2500 | 500 | 100 | 2500 | 500 | 100 |
| GA156 | GGTGCTAGCCTTGCGTTCCG | 66 | 26.34 | 6.22 | 1.48 | 33.94 | 14.31 | 2.34 |
| GA157 | GCCGTCCTCCTCGGAACGCA | 151 | 10.03 | 2.82 | 0.62 | 13.78 | 2.93 | 0.78 |
| GA158 | GCTAGCCTTGCGTTCCGAGG | 152 | 37.94 | 6.55 | 2 | 18.27 | 4.42 | 1.04 |
| GA159 | GCGTTCCGAGGAGGACGGCC | 153 | 14.68 | 3.74 | 1.35 | 12.21 | 3.69 | 1.19 |
| GA160 | GCCTTGCGTTCCGAGGAGGA | 154 | 23.3 | 5.58 | 1.19 | 23.15 | 6.60 | 1.38 |
| GA161 | GGACGAGGACGGCGACTACG | 155 | 35.08 | 8.74 | 3.65 | 48.24 | 14.98 | 4.52 |
| GA162 | GGACGGCGACTACGAGGAGC | 156 | 42.8 | 12.97 | 2.14 | 28.26 | 11.18 | 1.62 |
| GA163 | CGTCCTCGTCCTCCTGCGCA | 157 | 29.32 | 9.2 | 2.31 | 49.50 | 17.69 | 5.99 |
| GA164 | GTCCTCGTCCTCCTGCGCAC | 158 | 25.77 | 11.12 | 2.68 | 34.89 | 13.96 | 2.75 |
| GA165 | CCGTCAGCTCCAGGCGGTCC | 159 | 40.27 | 22.3 | 4.99 | 35.57 | 18.00 | 5.43 |
| GA166 | CGCCCGTGCGCAGGAGGACG | 160 | 36.89 | 10.99 | 2.89 | 44.77 | 14.39 | 3.93 |
| GA167 | TCAGCTCCAGGCGGTCCTGG | 161 | 53.71 | 25.87 | 8.2 | 66.07 | 35.98 | 11.98 |

TABLE 2-continued

PCSK9 gRNA/SpCas9 editing in primary hepatocytes

| gRNA | Protospacer (5'-3') | SEQ ID NO: | Human Primary Hepatocyte Editing % | | | Cyno Primary Hepatocyte Editing % | | |
|---|---|---|---|---|---|---|---|---|
| | | | 2500 | 500 | 100 | 2500 | 500 | 100 |
| GA168 | CTTGGCGCAGCGGTGGAAGG | 162 | 54.99 | 25.77 | ND | 41.49 | 15.90 | 4.75 |
| GA169 | CGTGCGCAGGAGGACGAGGA | 163 | 46.65 | 15.15 | 5.49 | 42.38 | 18.28 | 3.45 |
| GA170 | CCAGGACCGCCTGGAGCTGA | 164 | 31.35 | 15.84 | 2.9 | 23.17 | 11.48 | 4.03 |
| GA171 | TCTTGGTGAGGTATCCCCGG | 165 | 31.75 | 9.38 | 2.37 | 27.79 | 9.06 | 1.29 |
| GA172 | CAGTGCGCTCTGACTGCGAG | 166 | 14.01 | 3.52 | 0.32 | 15.58 | 2.11 | 0.51 |
| GA173 | CTTGGTGAGGTATCCCCGGC | 167 | 23.38 | 3.94 | 0.69 | 35.03 | 8.70 | 2.06 |
| GA174 | GGATCTTGGTGAGGTATCCC | 168 | 14.74 | 5.24 | 1.18 | 18.65 | 4.88 | 1.60 |
| GA175 | GAAGATGAGTGGCGACCTGC | 169 | 24.81 | 7.53 | 1.55 | 44.77 | 12.37 | 1.45 |
| GA176 | AGCACCACCACGTAGGTGCC | 170 | 4.98 | 1.26 | 0.36 | 22.65 | 8.11 | 2.11 |
| GA177 | GGTCGCCACTCATCTTCACC | 171 | 12.57 | 2.67 | 0.65 | 15.91 | 4.68 | 0.38 |
| GA178 | CTCCTTCAGCACCACCACGT | 172 | 18.29 | 5.43 | 1.26 | 25.22 | 5.78 | 2.21 |
| GA179 | GAGTGGCGACCTGCTGGAGC | 173 | 21.87 | 6 | 1.29 | 12.94 | 4.21 | 1.06 |
| GA180 | GCGCACTGCCCGCCGCCTGC | 174 | 17.16 | 2.22 | 0.22 | 14.12 | 2.45 | 0.91 |
| GA181 | GGCTTCCTGGTGAAGATGAG | 175 | ND | ND | 28.87 | 45.12 | 15.43 | 3.66 |
| GA182 | CACCTACGTGGTGGTGCTGA | 176 | 17.44 | 4.49 | 0.95 | 22.89 | 6.14 | 1.55 |
| GA183 | CTACGTGGTGGTGCTGAAGG | 177 | 32.35 | 9.89 | 2.21 | 39.56 | 15.99 | 2.87 |
| GA184 | ATGGAAGACATGCAGGATCT | 178 | 29.55 | 8.29 | 2.65 | 31.87 | 10.54 | 2.90 |
| GA185 | AGACATGCAGGATCTTGGTG | 179 | 27.98 | 10.91 | 1.6 | 20.29 | 7.75 | 1.14 |
| GA186 | CTCATCTTCACCAGGAAGCC | 180 | 12.01 | 3.57 | 0.79 | 33.48 | 7.59 | 1.96 |
| GA187 | CTCCTCGATGTAGTCGACAT | 181 | ND | 6.47 | 2.44 | 29.24 | 12.30 | 3.77 |
| GA188 | TATTCATCCGCCCGGTACCG | 182 | 41.02 | 15.38 | 4.21 | 0.06 | 0.01 | 0.01 |
| GA189 | TCCTCGATGTAGTCGACATG | 183 | 31.23 | 8.94 | 1.76 | 41.70 | 15.58 | 3.30 |
| GA190 | CCTCCTCGATGTAGTCGACA | 184 | 25.39 | 9.73 | 2.78 | 26.78 | 5.53 | 1.17 |
| GA191 | GCCCCATGTCGACTACATCG | 185 | 34.6 | 12.2 | 3 | 51.79 | 26.79 | 5.46 |

TABLE 2-continued

PCSK9 gRNA/SpCas9 editing in primary hepatocytes

| gRNA | Protospacer (5'-3') | SEQ ID NO: | Human Primary Hepatocyte Editing % | | | Cyno Primary Hepatocyte Editing % | | |
|---|---|---|---|---|---|---|---|---|
| | | | 2500 | 500 | 100 | 2500 | 500 | 100 |
| GA192 | CCATGTCGACTACATCGAGG | 186 | 16.7 | 6.02 | 1.14 | 10.26 | 1.50 | 0.60 |
| GA193 | GGGGCTGGTATTCATCCGCC | 187 | 35.77 | 15.68 | 3.92 | 52.89 | 32.02 | 8.70 |
| GA194 | GTCGACATGGGGCAACTTCA | 188 | 32.97 | 12.39 | 2.32 | 30.91 | 9.49 | 2.38 |
| GA195 | ACCACCGGGAAATCGAGGGC | 189 | 12.57 | 13.3 | 3.58 | 18.78 | 4.77 | 0.69 |
| GA196 | GAGTGACCACCGGGAAATCG | 190 | 17.19 | 2.9 | 0.75 | 27.79 | 3.4 | 1.09 |
| GA197 | AGTGACCACCGGGAAATCGA | 191 | 15.03 | 3.29 | 1.22 | 18.21 | 3.89 | 0.9 |
| GA198 | CCACCGGGAAATCGAGGGCA | 192 | 30.93 | 10.58 | 0.04 | 49 | 16.15 | 3.53 |
| GA199 | GAAGCGGGTCCCGTCCTCCT | 193 | 29.95 | 6.89 | 1.17 | 45.32 | 15.11 | 3.07 |
| GA200 | CTAGGAGATACACCTCCACC | 194 | 5.31 | 8.68 | 3.8 | 54.36 | 20.51 | 5.15 |
| GA201 | CAGCATACAGAGTGACCACC | 195 | 31.51 | 12.92 | 3.29 | 44.01 | 14.37 | 4.33 |
| GA202 | AAGCGGGTCCCGTCCTCCTC | 196 | 34.75 | 10.75 | 2.54 | 31.13 | 8.91 | 1.54 |
| GA203 | TGACCCTGCCCTCGATTTCC | 197 | 37.02 | 12.76 | 2.57 | 32.85 | 10.49 | 3.66 |
| GA204 | CACTCTGTATGCTGGTGTCT | 198 | 24.98 | 8.98 | 1.27 | 19.37 | 5.27 | 0.91 |
| GA205 | CCCTGCCCTCGATTTCCCGG | 199 | 38.04 | 12.42 | 3.74 | 36.43 | 12.04 | 3.01 |
| GA206 | CCGGTGGTCACTCTGTATGC | 200 | 20.73 | 2.7 | 0.85 | 16.9 | 2.73 | 0.84 |
| GA207 | GGAAATCGAGGGCAGGGTCA | 201 | 20.79 | 3.46 | 0.84 | 19.16 | 2.72 | 1.05 |
| GA208 | CCAGCATACAGAGTGACCAC | 202 | 25.76 | 5.72 | 1.38 | 25.07 | 6.01 | 1.15 |
| GA209 | CTTGGCAGTTGAGCACGCGC | 203 | 33.23 | 8.76 | 0.02 | 40.78 | 13.96 | 3.59 |
| GA210 | CTGCGCGTGCTCAACTGCCA | 204 | 14.3 | 5.86 | 0.04 | 54.88 | 19.72 | 4.5 |
| GA211 | TGCGCGTGCTCAACTGCCAA | 205 | 38.07 | 10.29 | 1.31 | 28.63 | 8.3 | 1.01 |
| GA212 | CGGGATGCCGGCGTGGCCAA | 206 | 12.45 | 5.59 | 1.17 | 54.89 | 16.53 | 1.96 |
| GA213 | CGTGCTCAACTGCCAAGGGA | 207 | 24.28 | 8.77 | 2.17 | 45.22 | 16.35 | 2.73 |
| GA214 | CCTTGGCCACGCCGGCATCC | 208 | 22.92 | 6.28 | 1.94 | 50.35 | 14.84 | 3.06 |
| GA215 | CAGCGGCCGGGATGCCGGCG | 209 | 4.94 | 1.01 | 0.13 | 7.52 | 1.07 | |

TABLE 2-continued

PCSK9 gRNA/SpCas9 editing in primary hepatocytes

| gRNA | Protospacer (5'-3') | SEQ ID NO: | Human Primary Hepatocyte Editing % | | | Cyno Primary Hepatocyte Editing % | | |
|---|---|---|---|---|---|---|---|---|
| | | | 2500 | 500 | 100 | 2500 | 500 | 100 |
| GA216 | CCGGGATGCCGGCGTGGCCA | 210 | 14.65 | 3.7 | 0.95 | 37.79 | 4.97 | 1.77 |
| GA217 | GTGGTCAGCGGCCGGGATGC | 211 | 15.31 | 2.75 | 0.77 | 39.21 | 10.2 | 2.6 |
| GA218 | CGCTGACCACCCCTGCCAGG | 212 | 31.71 | 8.96 | 3.81 | 58.66 | 19.95 | 5.42 |
| GA219 | GGCAGGGGTGGTCAGCGGCC | 213 | 15.97 | 4.57 | 1.28 | 48.67 | 11.89 | 0.35 |
| GA220 | GTGCTCAACTGCCAAGGGAA | 214 | 21.87 | 9.12 | 2.17 | 45.17 | 12.39 | 3.13 |
| GA221 | TCATGGCACCCACCTGGCAG | 215 | 29.35 | 7.48 | 1.11 | 57.4 | 20.27 | 2.82 |
| GA222 | TGGCAGGGGTGGTCAGCGGC | 216 | 2.04 | 0.66 | 0.5 | 16.7 | 3.32 | 0.88 |
| GA223 | GCTGACCACCCCTGCCAGGT | 217 | 17.5 | 7.28 | 1.44 | 57.58 | 21.4 | 3.46 |
| GA224 | GGCCGCTGACCACCCCTGCC | 218 | 13.02 | 2.19 | 1.01 | 47.5 | 12.34 | 2.61 |
| GA225 | GGCATCGTCCCGGAAGTTGC | 219 | 18.82 | 6.39 | 0.89 | 8.57 | 3.11 | 2.03 |
| GA226 | GGCTTTTCCGAATAAACTCC | 220 | 7.61 | 2.99 | 0.4 | ND | ND | ND |
| GA227 | GTCCCGGAAGTTGCCGGCAG | 221 | 32.09 | 8.29 | 0.02 | 32.41 | 4.58 | 0.56 |
| GA228 | CGGCTGTACCCACCCGCCAG | 222 | 37.1 | 10.96 | 5.9 | 31.36 | 7.89 | 1.95 |
| GA229 | GTCGTGCTGGTCACCGCTGC | 223 | 30.41 | 6.85 | 0.47 | 34.28 | 5.39 | 0.75 |
| GA230 | AGTAGAGGCAGGCATCGTCC | 224 | 29.31 | 12.83 | ND | 35.86 | ND | ND |
| GA231 | TCCGAATAAACTCCAGGCCT | 225 | ND | ND | ND | ND | ND | ND |
| GA232 | GTTTATTCGGAAAAGCCAGC | 226 | ND | ND | ND | ND | ND | ND |
| GA233 | GCGGCTGTACCCACCCGCCA | 227 | 19.97 | 5.39 | 3.08 | 37.8 | 10.84 | 2.38 |
| GA234 | CGCCTGCCAGCGCCTGGCGA | 252 | 5.45 | 2.29 | 0.06 | 6.44 | 1.53 | 0.21 |
| GA235 | CACCGCTGCCGGCAACTTCC | 228 | ND | ND | ND | 50.03 | 17.51 | 2.51 |
| GA236 | AGCCCTCGCCAGGCGCTGGC | 229 | 22.41 | 3.13 | 6.92 | 37.44 | 11.62 | 2.31 |
| GA237 | CAACGCCGCCTGCCAGCGCC | 230 | 36.78 | 15.83 | 4.53 | 46.01 | 13.46 | 2.17 |
| GA238 | GCACGACCCCAGCCCTCGCC | 231 | ND | ND | ND | 17.92 | 4.01 | 0.94 |
| GA239 | CCGCCTGCCAGCGCCTGGCG | 232 | 3.49 | 1.73 | 0.06 | 4.55 | 0.55 | 0.02 |

TABLE 2-continued

PCSK9 gRNA/SpCas9 editing in primary hepatocytes

| gRNA | Protospacer (5'-3') | SEQ ID NO: | Human Primary Hepatocyte Editing % | | | Cyno Primary Hepatocyte Editing % | | |
|---|---|---|---|---|---|---|---|---|
| | | | 2500 | 500 | 100 | 2500 | 500 | 100 |
| GA240 | TGCCAGCGCCT GGCGAGGGC | 233 | 7.94 | 0.24 | 1.05 | 10.62 | 1.9 | 0.52 |
| GA241 | TGCTGCTGCCC CTGGCGGGT | 234 | 5.39 | 1.49 | 0.61 | 16.11 | 2.94 | 0.97 |
| GA242 | TCACCGCTGCC GGCAACTTC | 235 | ND | ND | ND | 31.71 | 7.13 | 1.79 |
| GA243 | GGCGAGGGCT GGGGTCGTGC | 236 | ND | ND | ND | 10.18 | 1.84 | 0.51 |
| GA244 | TTCCGAATAAA CTCCAGGCC | 237 | ND | ND | ND | 28.16 | 7.89 | 1.63 |
| GA245 | GTGCTGCTGCC CCTGGCGGG | 238 | 2.9 | 2.97 | 1.68 | 7.07 | 0.88 | 0.19 |
| GA246 | GCCAGCGCCTG GCGAGGGCT | 239 | 17.95 | 2.17 | 0.08 | 24.63 | 5.78 | 1.11 |
| GA247 | CCTCGCCAGGC GCTGGCAGG | 240 | 6.76 | 0.17 | 0.25 | 11.48 | 2.62 | 0.71 |

TABLE 3

ANGPTL3 gRNA/SpCas9 editing in primary hepatocytes

| gRNA | Protospacer (5'-3') | SEQ ID NO: | Human Primary Hepatocyte Editing % | | Cyno Primary Hepatocyte Editing % | |
|---|---|---|---|---|---|---|
| | | | 500 ng/mL | 100 ng/ml | 500 ng/ml | 100 ng/mL |
| GA107 | AGCCAATGGCC TCCTTCAGT | 105 | 5.09 | 3.72 | ND | 32.58 |
| GA108 | TCCCAACTGAA GGAGGCCAT | 106 | 19.43 | 4.95 | 15.49 | 4.11 |
| GA109 | GGCCTCCTTCA GTTGGGACA | 107 | 18.07 | 6.60 | 15.11 | 4.15 |
| GA110 | GACCATGTCCC AACTGAAGG | 108 | 13.63 | 5.37 | 15.99 | 8.59 |
| GA111 | GCCAATGGCCT CCTTCAGTT | 109 | 24.08 | 10.72 | 28.98 | 22.61 |
| GA113 | ATTCTGGAGGA AATAACTAG | 111 | 19.97 | 6.00 | 26.67 | 12.07 |
| GA115 | AACATAGCAAA TCTTGATTT | 113 | ND | ND | 25.51 | 12.58 |
| GA116 | GTAGAATTTTTT CTTCTAGG | 114 | 16.33 | 3.78 | 19.83 | 10.84 |
| GA117 | ACTACAAGTCA AAAATGAAG | 115 | 16.55 | 7.08 | 26.11 | 10.01 |
| GA122 | CTTTTATTTGAC TATGCTGT | 120 | 13.82 | 4.45 | 16.76 | 7.28 |
| GA125 | TGATGGTAAGA CACTTTGGT | 123 | 16.27 | 5.04 | 19.72 | 12.91 |

TABLE 3-continued

ANGPTL3 gRNA/SpCas9 editing in primary hepatocytes

| gRNA | Protospacer (5'-3') | SEQ ID NO: | Human Primary Hepatocyte Editing % | | Cyno Primary Hepatocyte Editing % | |
|---|---|---|---|---|---|---|
| | | | 500 ng/mL | 100 ng/ml | 500 ng/ml | 100 ng/mL |
| GA126 | GGAGTAGTTCT TGGTGCTCT | 124 | 15.21 | 6.73 | 17.57 | 8.29 |
| GA127 | AACATGATGGT AAGACACTT | 125 | 18.74 | 5.77 | 33.67 | 19.89 |
| GA128 | TGAAGAAAGGG AGTAGTTCT | 126 | 25.39 | 10.29 | 32.55 | 0.19 |
| GA129 | AGTTCTTGGTGC TCTTGGCT | 127 | ND | ND | 20.06 | 5.36 |
| GA130 | ATGATGGTAAG ACACTTTGG | 128 | 17.09 | 7.51 | 25.90 | 14.60 |
| GA131 | GAAGATAGAGA AATTTCTGT | 129 | 18.64 | ND | 27.57 | 10.10 |
| GA132 | GGAAGATAGAG AAATTTCTG | 130 | 28.39 | 15.25 | 26 | 15 |
| GA137 | TATCAGGTAAA ACCTGTCTA | 135 | 29.70 | 11.44 | 30.57 | 28.01 |
| GA141 | TTGAGAGTTGC TGGGTCTGA | 139 | 14.87 | 5.80 | 10.32 | 5.49 |
| GA142 | TGAAAAACTTG AGAGTTGCT | 140 | 24.90 | 10.50 | 27.59 | 20.09 |
| GA143 | TTAATTCAACAT CGAATAGA | 141 | 19.36 | 9.30 | 21.16 | 14.84 |
| GA145 | CATTATATTCAG GTAGTCCA | 143 | 26.33 | 12.55 | 30.34 | 18.77 |
| GA148 | ACAAAACTTCA ATGAAACGT | 146 | 31.67 | 12.01 | 69.75 | 28.57 |
| GA151 | GAGAACTACAA ATATGGTTT | 149 | 31.88 | 10.56 | 38.91 | 11.32 |

Figure 1B:
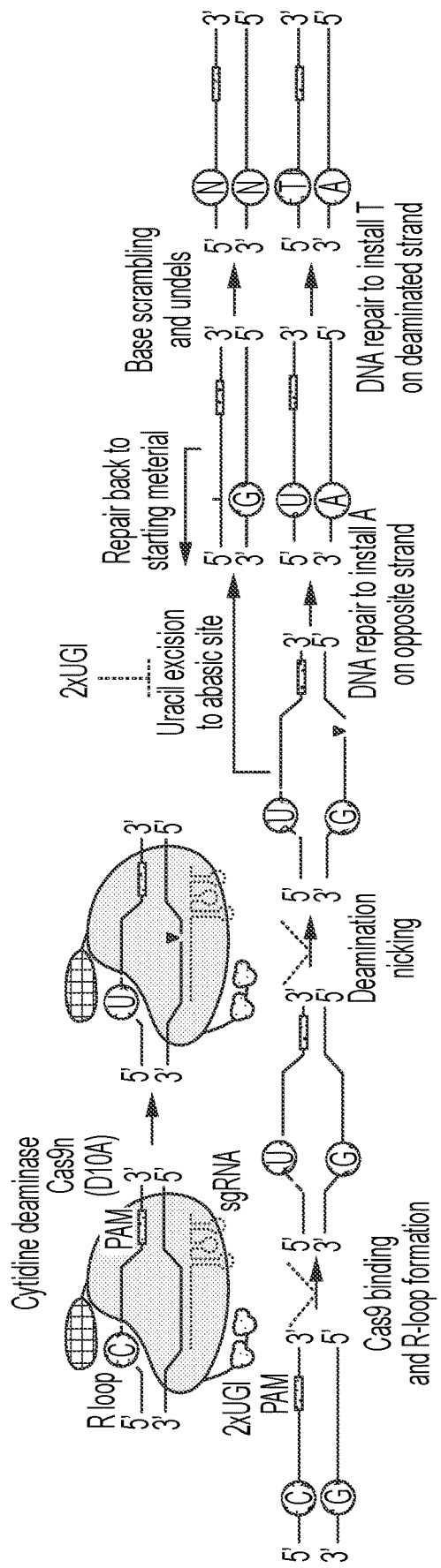
FIG. 1D is a schematic representation of how mcPCSK9 guide RNA (gRNA)-Tracr disclosed herein were designed. Shown is a ribonucleoprotein (RNP)-single guide RNA (sgRNA) alignment with stem-loop guide intramolecular interactions (W-C base pairing at the stem). The tracrRNA sequence of the gRNA serves as a binding scaffold for the cas protein. When designing a gRNA, loop nucleotides can be aligned with a protein and the interaction of base (H-bond), 2'-hydroxyl (2'-OH), 4'-oxygen (ring-oxygen) of the sugar moiety, phosphate linkage of each nucleotide to amino acid side chains of the protein can be considered in the design of a gRNA-Tracr. Spatial arrangement of nucleotide within RNP-steric interaction, room to accommodate bulky substitution like 2'-O-Methyl (2'-OMe) and phosphorothioate (PS) can be also taken into consideration.
Figure 1C:
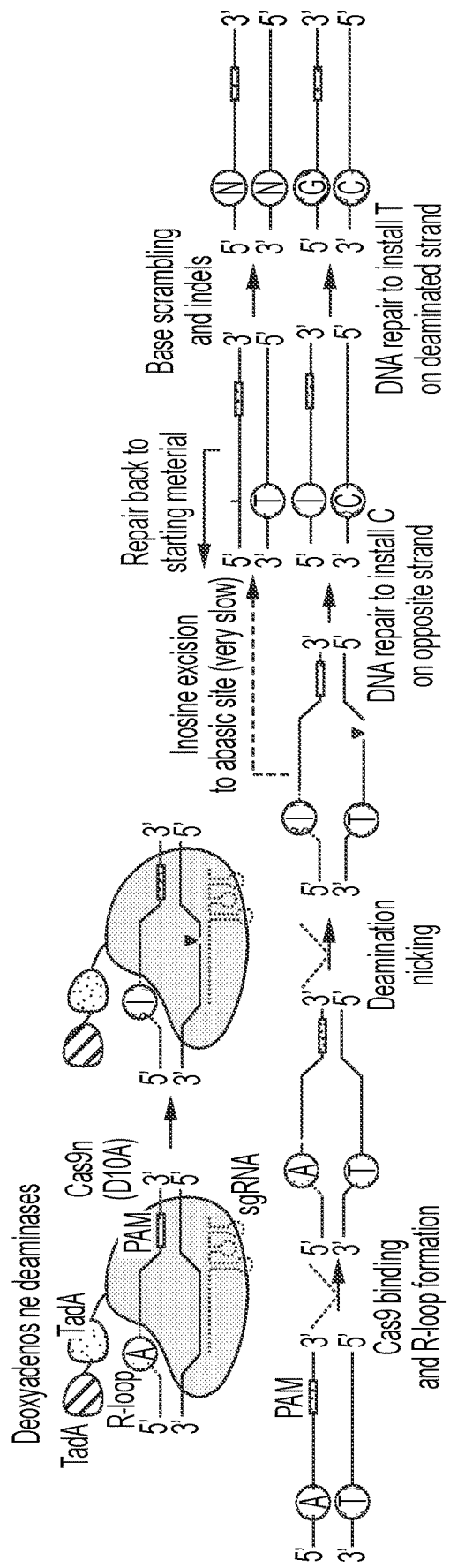
Figure 1D:
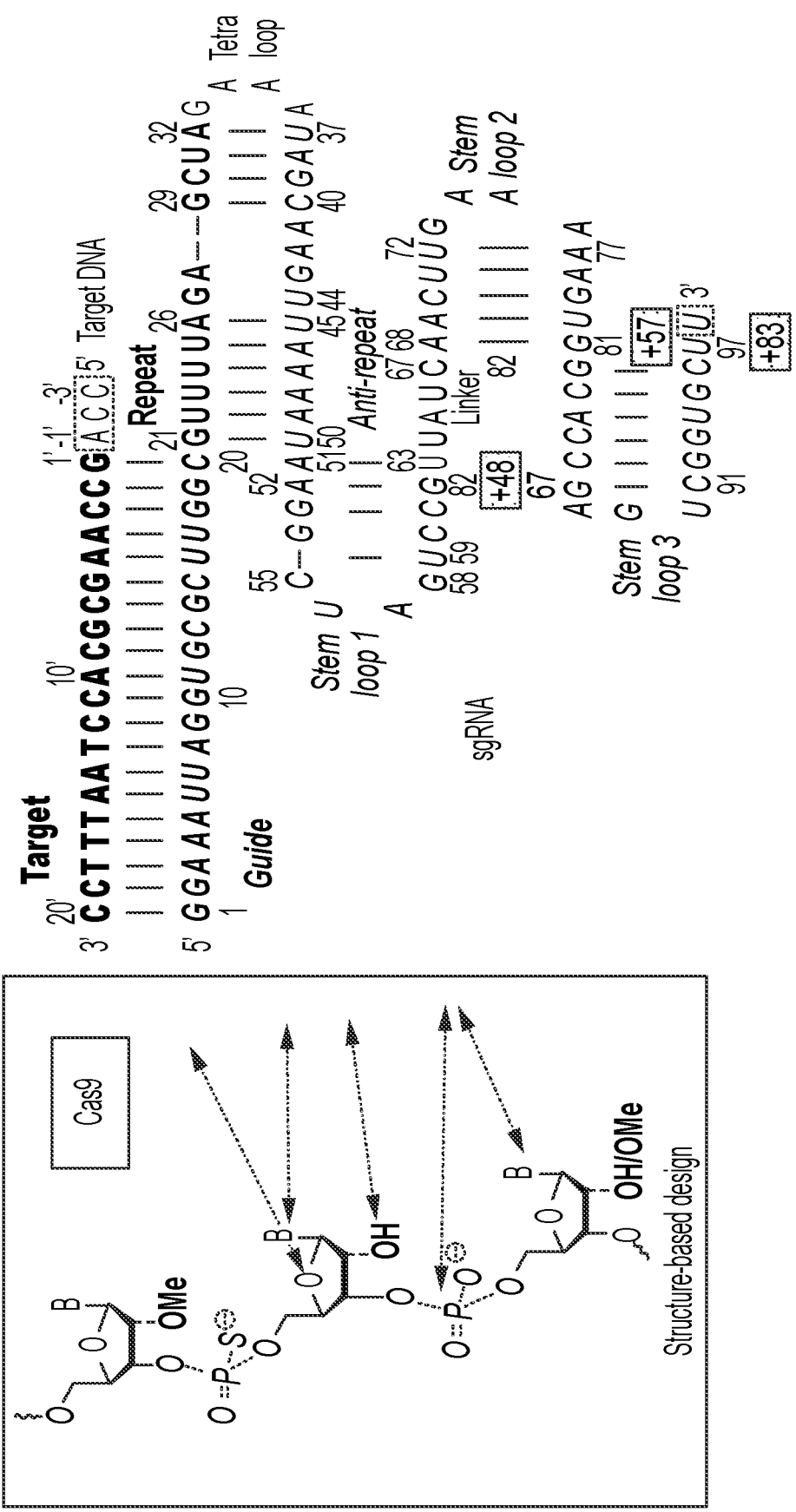
Figure 3:
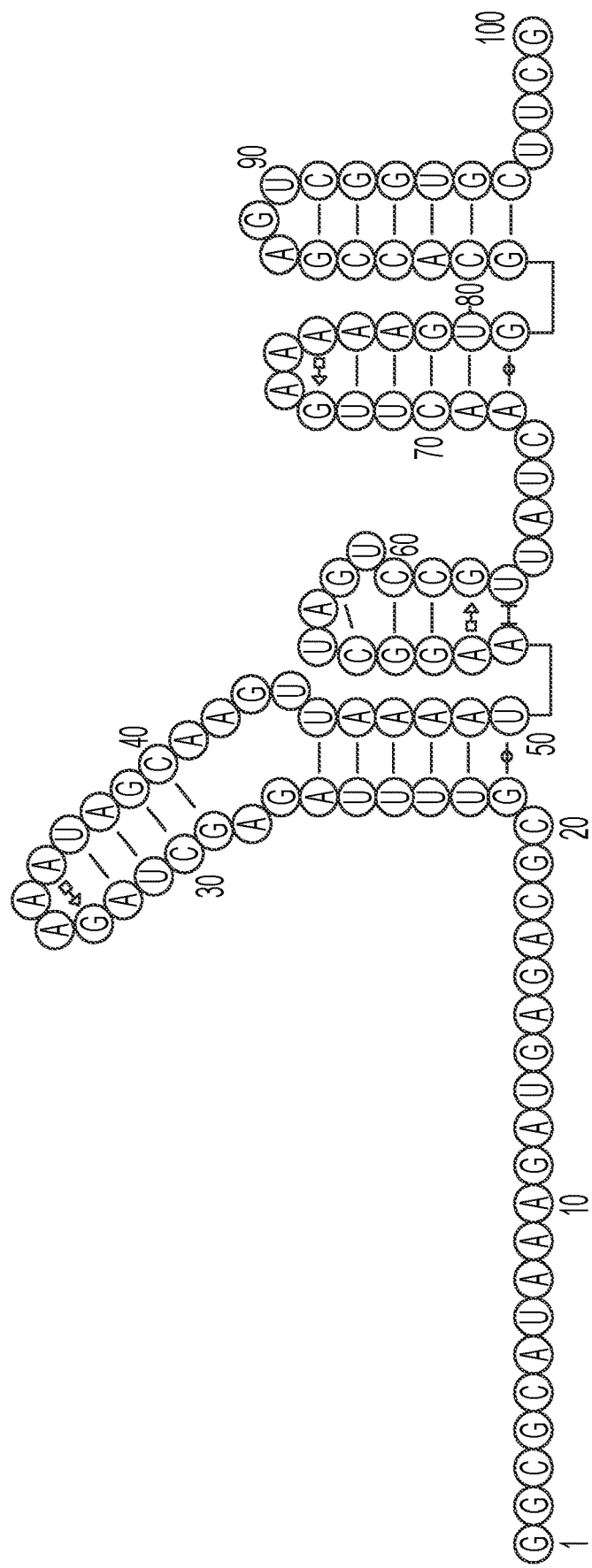
FIG. 3 depicts a gRNA secondary structure of a sgRNA based on the 4ZT0 and 5F9R crystal structures, in which the sgRNA is bound to SpCas9 either as an RNP alone or as part of a ternary complex with DNA. Secondary structure relationships are shown in the Leontis and Westhof nomenclature (RNA, 2001, 7, 499-512) (SEQ ID NO: 72).
Figure 4:
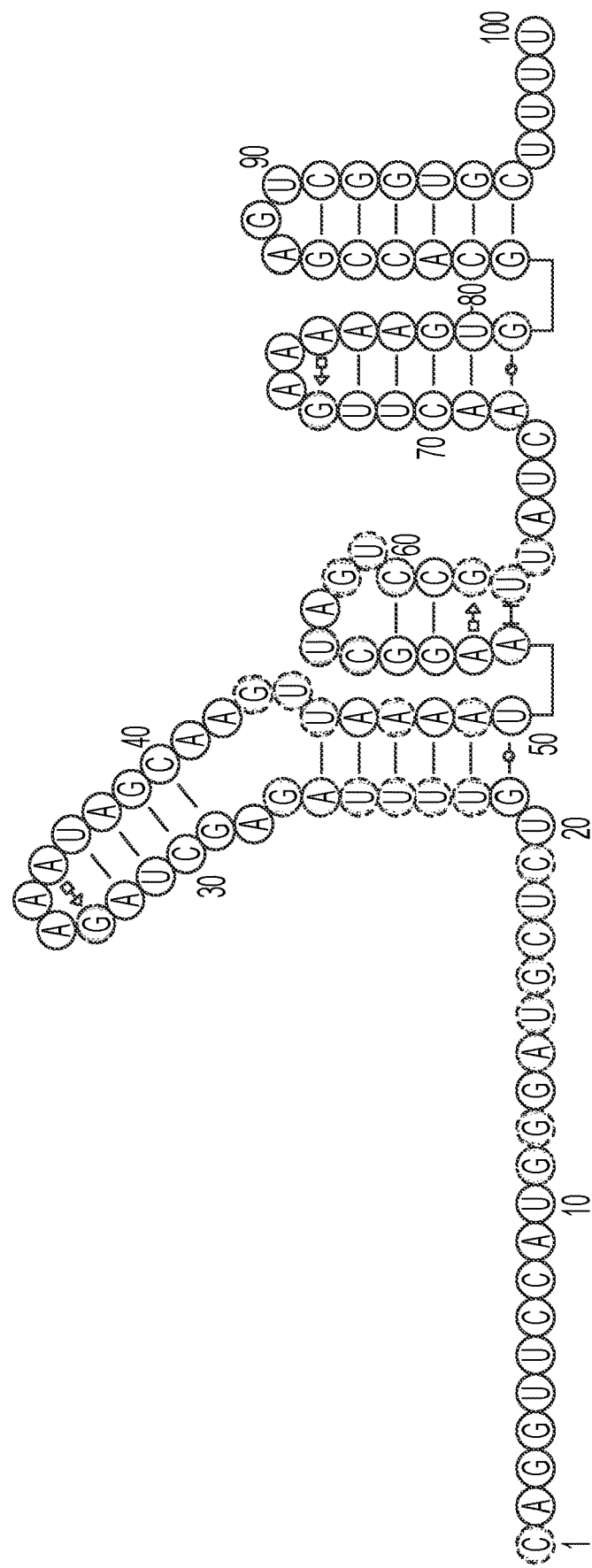
FIG. 4 depicts a gRNA secondary structure with a PCSK9 spacer showing predicted contacts based on RNP PDB 4ZT0 (sgRNA+SpCas9 RNP). Positions 1-10 and positions 83-100 were not modeled in this crystal structure due to a lack of clear electron density (SEQ ID NO: 73). Black circle with white letter labels: protein contact, light gray with black letter: steric clash if 2'-O-Me incorporated or distant contact, dark grey with black letter: RNA contact. As a person of skill in the art would understand, the term "clash" as used herein refers to physically-unlikely overlapping atomic volumes in a structure. Incorporation of a 2'O-Me modification in these situations would potentially result in structural rearrangement(s) that could be detrimental to RNP function. As a person of skill in the art would understand, the term "contact" as used herein means a stable, non-covalent interaction between two functional groups, e.g. a hydrogen bond.
Figure 5:
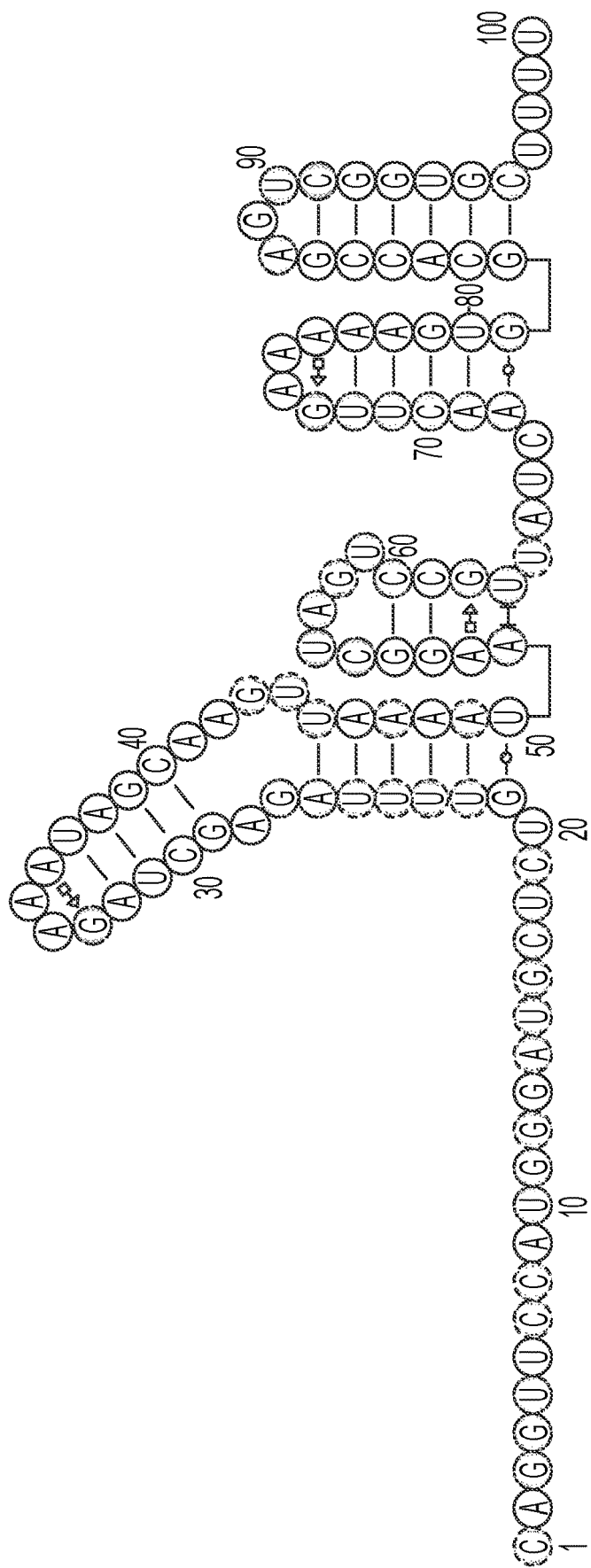
FIG. 5 depicts a gRNA secondary structure with a PCSK9 spacer showing predicted contacts based on PDB 5F9R (precatalytic ternary complex) (SEQ ID NO: 74). Black circle with white letter labels: protein contact, light gray with black letter: steric clash if 2'-O-Me incorporated or distant contact, dark grey with black letter: RNA contact.
Figure 6:
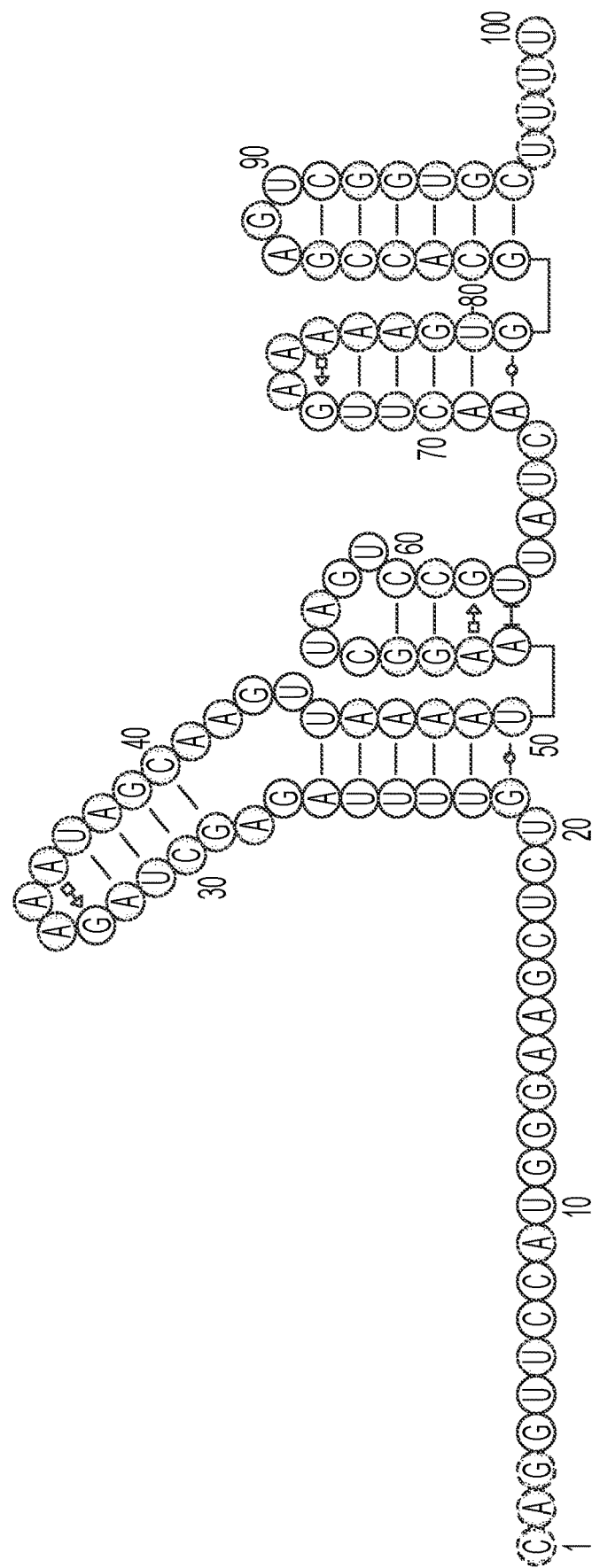
FIG. 6 depicts plausible positions of 2'-OMe substitutions determined by structure-based designs (SEQ ID NO: 73). Black circle with white letter labels: 2'-OMe and phosphorothioate substitution, light gray circle with black letter labels: 2'-OMe substitution only, white circle with black letter labels: unmodified nucleotide.
Figure 7A:
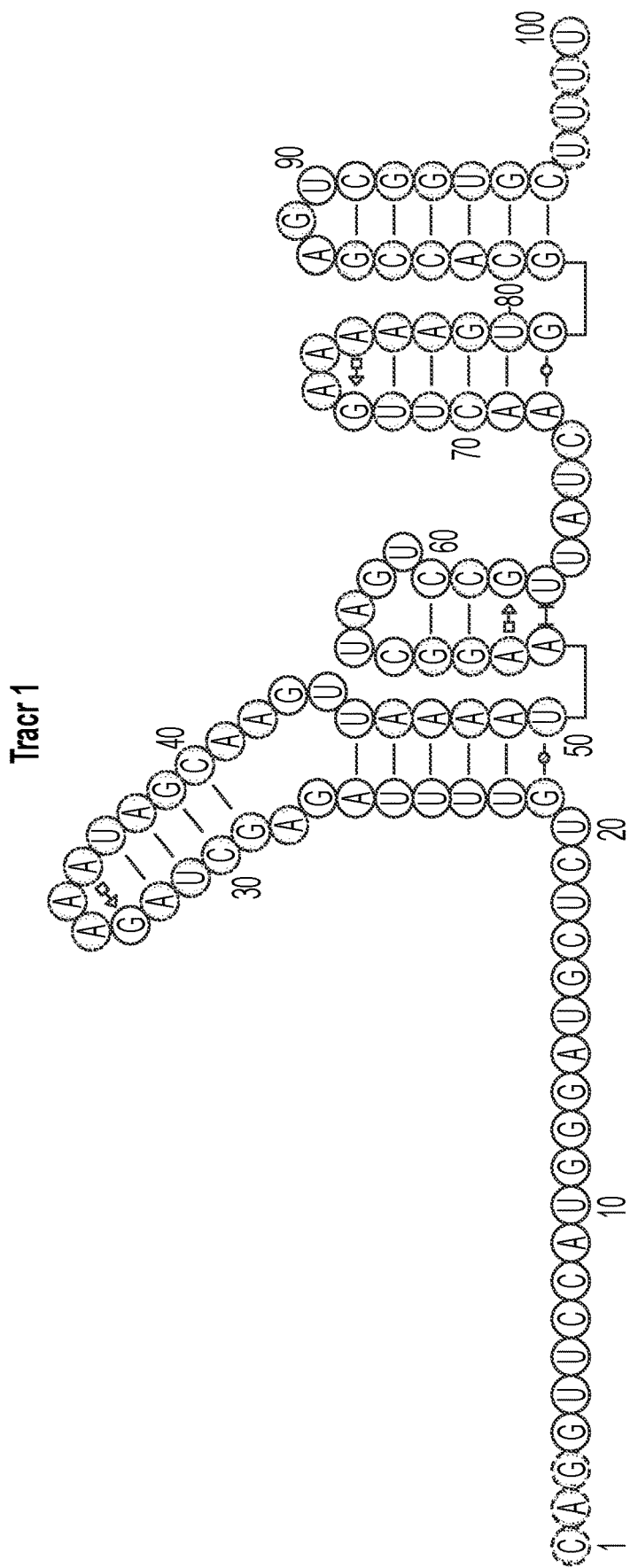
FIG. 7A depicts three patterns of 2'-OMe position identified in the tracr region of the single guide RNA from structure-guided incorporation of 2'-O-methylribosugar modification that produced robust editing in vivo: (1) mice.
Figure 7A:
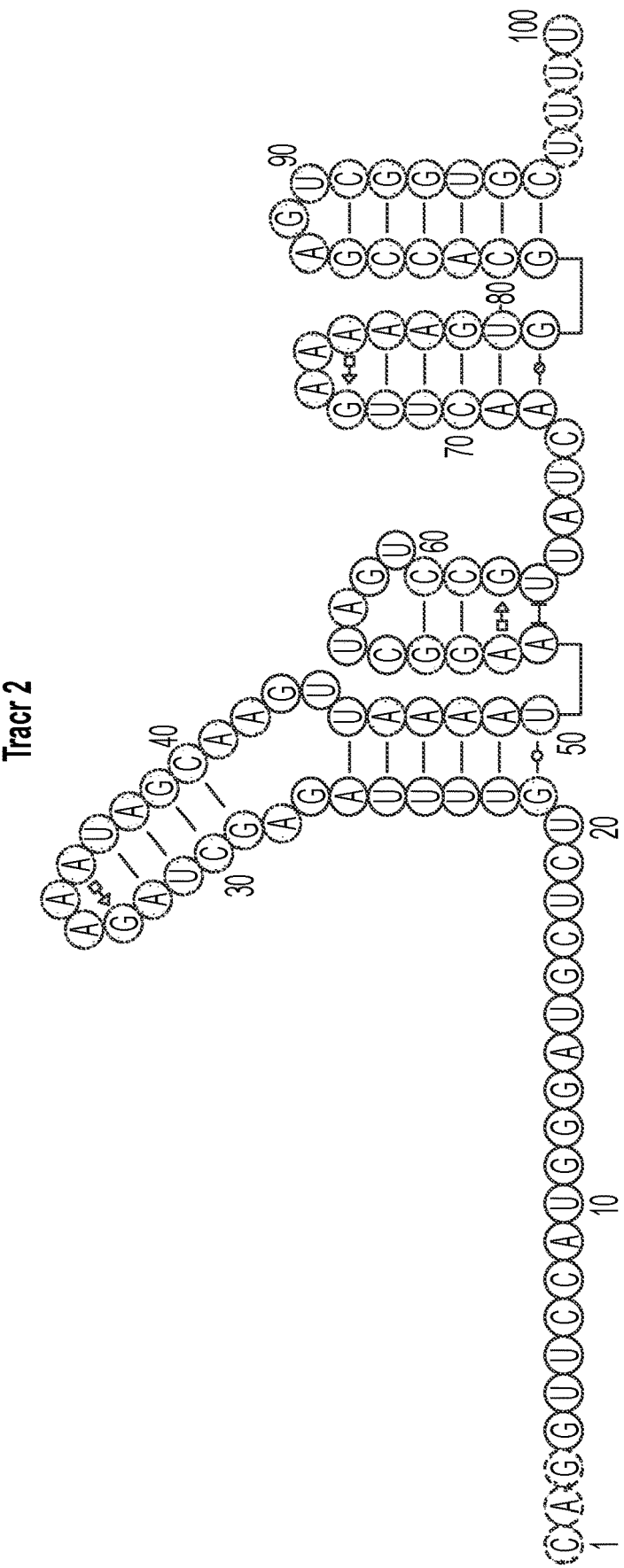
Figure 7A:
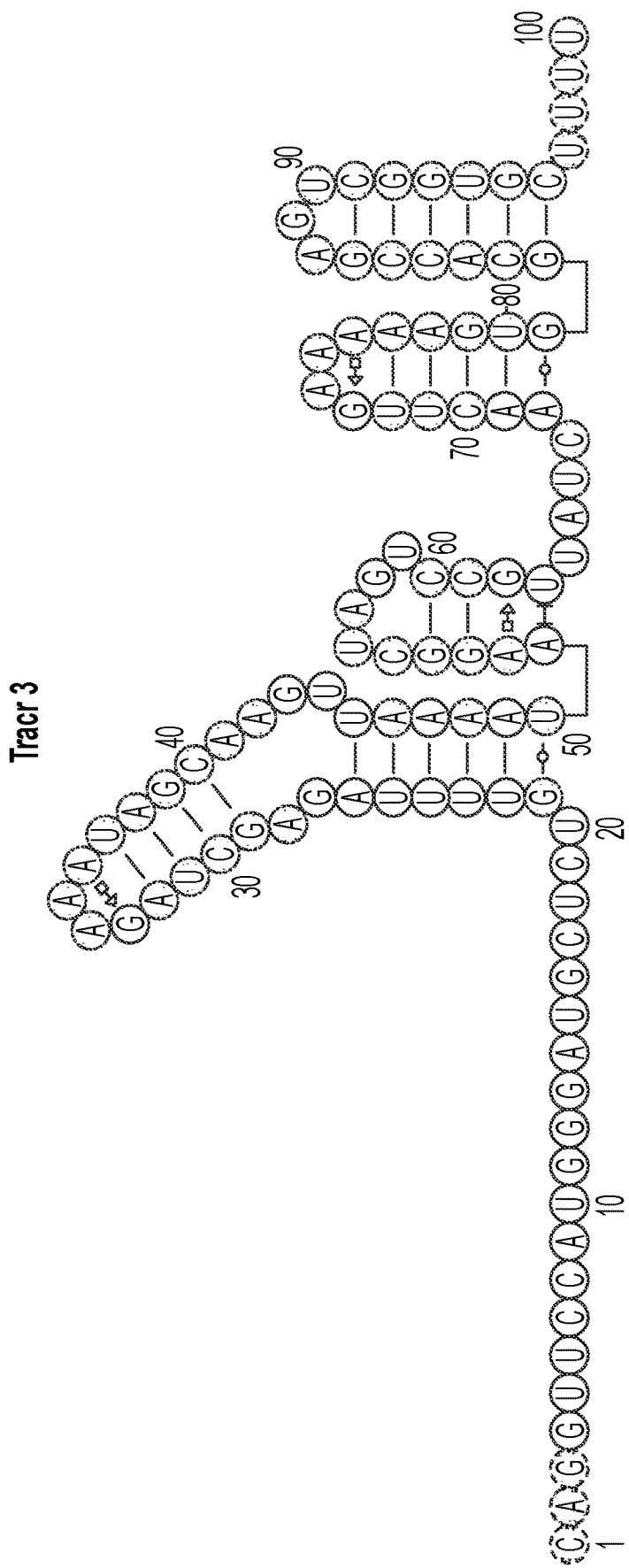

The nodes of operation of Cas9, cytidine base editors (CBE), and adenine base editors (ABE) respectively, along with relevant terminology used in this application including "protospacer", "PAM", "spacer" are illustrated (FIGS. 1A-1C) For one of the guides that performed well, GA156, with spacer sequence 5'-GGTGCTAGCCTTGCGTTCCG-3' (SEQ ID NO: 66), additional guides were synthesized with modifications to the tracrRNA sequence. Additionally, an X-ray crystal structure-guided approach was used (FIG. 1D). Structure-guided spacer and tracr designs were informed by the crystal structures of S. pyogenes Cas9 in complex with sgRNA (Jiang et al., 2015, PDB TD 4ZT0) and S. pyogenes Cas9 in a pre-catalytic ternary complex (Jiang et al., 2016, PDB TD 5F9R) (FIG. 2). Any positions in the crystal structures where there appeared to be a hydrogen bond between the 2'-OH of a given nucleotide and the Cas9 protein (or another part of the sgRNA) were left unmodified. Additionally, any positions where a steric clash was predicted to occur between a 2'-OMe and the protein were left unmodified. At sites where the 2'-OH was solvent-exposed or otherwise distant from protein residues, a 2'-OMe substitution was made. In cases where the two crystal structures disagreed, no modification was made. This strategy was applied to the entire sgRNA or just the tracr region. Exemplary structures are shown in FIGS. 3-7.

PCSK9 gRNAs were co-transfected with an equivalent amount of in vitro transcribed SpCas9 mRNA MS002 (1:1 ratio by weight) into primary human hepatocytes and processed as described in detailed methods. A wide range of editing activities were observed (Table 4; ND=Not determined). The guides with the highest editing activity at five days post transfection were GA001, GA002, GA007, and GA008. The structure-guided 2'-OMe heavy guide RNA (gRNA) designs GA007 and GA008 showed improved editing over minimally modified control gRNA GA009.

TABLE 4

In vitro evaluation of modified gRNA via SpCas9 editing in primary human hepatocytes

| gRNA | % Editing, day 3 | % Editing, day 5 |
|---|---|---|
| GA001 | 16 | 27 |
| GA002 | 28 | 23 |

TABLE 4-continued

In vitro evaluation of modified gRNA via SpCas9 editing in primary human hepatocytes

| gRNA | % Editing, day 3 | % Editing, day 5 |
|---|---|---|
| GA003 | ND | 7 |
| GA004 | 7 | 12 |
| GA005 | 1 | 15 |
| GA006 | ND | 12 |
| GA007 | 30 | 27 |
| GA008 | 20 | 28 |
| GA009 | 4 | 19 |

Example 3. PCSK9 and ANGPTL3 Base Editing In Vitro

Figure 8:
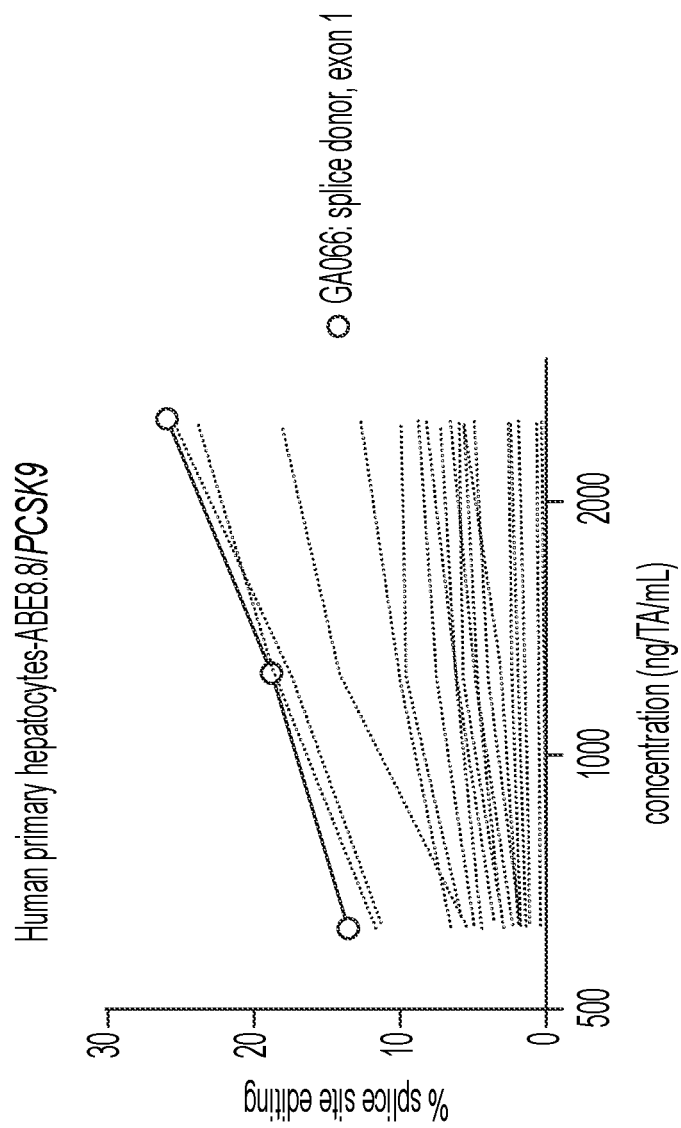
FIG. 8 shows base editing of the target splice site by an adenosine base editor system in modifying PCSK9 in primary human hepatocytes. The dark line represents the percent splice site editing obtained using gRNA identified a GA066.

Editing of PCSK9 by ABE8.8 was observed in primary hepatocytes. PCSK9 gRNAs were co-transfected with an equivalent amount of in vitro transcribed ABE8.8 mRNA MA002 (1:1 ratio by weight) into primary hepatocytes and processed as described in detailed methods. In one set of experiments, extracted genomic DNA was analyzed for base editing of the target splice site with next-generation sequencing of PCR amplicons generated around the target sites. Samples were prepared using the Nextera XT DNA library preparation kit (Illumina) according to the manufacturer's protocol. Briefly, two rounds of PCR were performed first to amplify the region of interest and second to add DNA sequences required for next generation sequencing and sample identification to the initial product. The final amplicon was sequenced on the Illumina MiSeq instrument according to the manufacturer's protocol. A wide range of editing activities (Table 5; FIG. 8) were observed, with guides GA066, GA073, and GA074 performing the best.

TABLE 5

ABE8.8/PCSK9 gRNA editing in primary hepatocytes

| gRNA | Species | Human Primary Hepatocytes-splice site editing % | | | Cynomolgous Primary Hepatocytes-splice site editing % | | |
|---|---|---|---|---|---|---|---|
| | | 5000 ng/mL | 2500 ng/mL | 1250 ng/mL | 5000 ng/mL | 2500 ng/mL | 1250 ng/mL |
| GA066 | Human/Cyno | 25.9 | 18.7 | 13.6 | 24.3 | 29.1 | 21.4 |
| GA072 | Human/Cyno | 2.5 | 2.2 | 1.5 | 2.2 | 1.7 | 2.3 |
| GA073 | Human/Cyno | 25.4 | 17.5 | 11.2 | 29.2 | 23.2 | 24.7 |
| GA074 | Human/Cyno | 23.8 | 18.8 | 11.6 | 18.7 | 20.1 | 17.5 |
| GA075 | Human/Cyno | 5.5 | 3.1 | 1.8 | ND | ND | ND |
| GA076 | Human/Cyno | 4.9 | 3.9 | 1.6 | ND | ND | ND |
| GA077 | Human/Cyno | 6.0 | 5.7 | 2.8 | 5.4 | 5.7 | 4.1 |
| GA078 | Human/Cyno | 12.6 | 10.0 | 6.5 | ND | ND | ND |
| GA079 | Human/Cyno | 6.5 | 4.9 | 2.2 | 0.5 | 0.5 | 0.6 |
| GA080 | Human/Cyno | 0.6 | 0.5 | 0.4 | 7.0 | 8.8 | 7.1 |
| GA081 | Human/Cyno | 8.3 | 6.1 | 4.3 | 0.3 | 0.3 | 0.3 |
| GA082 | Human/Cyno | 9.8 | 9.6 | 5.6 | ND | ND | ND |
| GA083 | Human/Cyno | 0.2 | 0.2 | 0.2 | ND | ND | ND |
| GA084 | Human/Cyno | 8.6 | 7.6 | 4.9 | ND | ND | ND |
| GA085 | Human/Cyno | 2.4 | 1.8 | 1.2 | ND | ND | ND |
| GA086 | Human/Cyno | 5.7 | 4.9 | 2.9 | ND | ND | ND |
| GA087 | Human/Cyno | 1.9 | 1.4 | 1.0 | 0.2 | 0.2 | 0.2 |
| GA088 | Human/Cyno | 7.2 | 6.2 | 3.6 | 24.8 | 23.0 | 17.0 |
| GA089 | Human/Cyno | 18.1 | 14.1 | 5.4 | ND | ND | ND |
| GA090 | Human/Cyno | 0.4 | 0.5 | 0.3 | ND | ND | ND |

Figure 9:
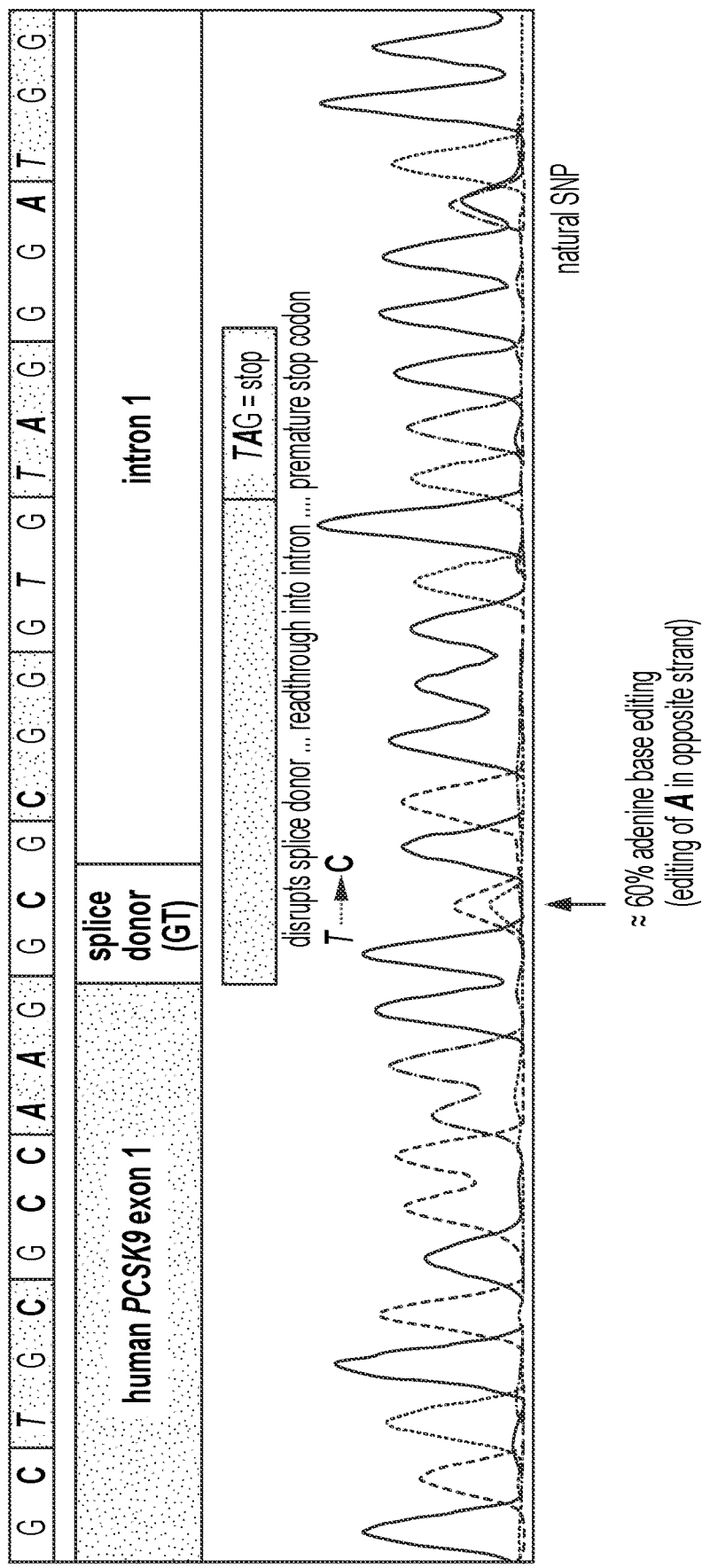
FIG. 9 depicts a Sanger sequencing chromatogram demonstrating editing of adenine base in the antisense strand at the splice donor at the end of PCSK9 exon 1 (PCR amplification from the genomic DNA of the cells transfected with the 2500-ng/mL dose), portraying how splice-site disruption results in an in-frame stop codon. Heterozygosity for a naturally occurring single nucleotide polymorphism (SNP) is evident downstream of the editing site. The scheme shows A-to-G base editing by an adenosine base editor system to knock-out PCSK9 in primary human hepatocytes.

When considering the data from primary human hepatocytes, PCSK9-targeting gRNAs were identified that matched the following three protospacer sequences as having the best cross-species activity between both primary human hepatocytes and primary cynomolgous hepatocytes: 5'-CCCGCACCTTGGCGCAGCGG-3' (SEQ ID NO: 13) (GA066), 5'-GCTTACCTGTCTGTGGAAGC-3' (SEQ TD NO: 67) (GA073), and 5'-TGCTTACCTGTCTGTGGAAG-3' (SEQ TD NO: 68) (GA074). The GA066 sequence targets the splice donor at the 5' end of human PCSK9 intron 1 and is predicted to result in an aberrant PCSK9 protein translated from exon 1, followed by several amino acids translated from the beginning of intron 1 (read through from exon 1 into intron 1), followed by a premature stop codon (FIG. 9). The GA073 and GA074 sequences each target the splice donor at the 5' end of human PCSK9 intron 4 and is predicted to result in an aberrant PCSK9 protein translated from exons 1, 2, 3, and 4, followed by several amino acids translated from the beginning of intron 4 (readthrough from exon 4 into intron 4), followed by a premature stop codon. The predicted prematurely truncated protein in each of these cases is likely to have complete loss of function as well as having minimal immunogenicity due to the near-identical match to part of the naturally occurring wild-type human PCSK9 amino acid sequence. The same protospacer sequence, 5'-CCCGCACCTTGGCGCAGCGG-3' (SEQ ID NO: 13) (GA066), is found in the cynomolgus monkey genome, similarly targeting the splice donor at the 5' end of cyno PCSK9 intron 1.

Figure 10:
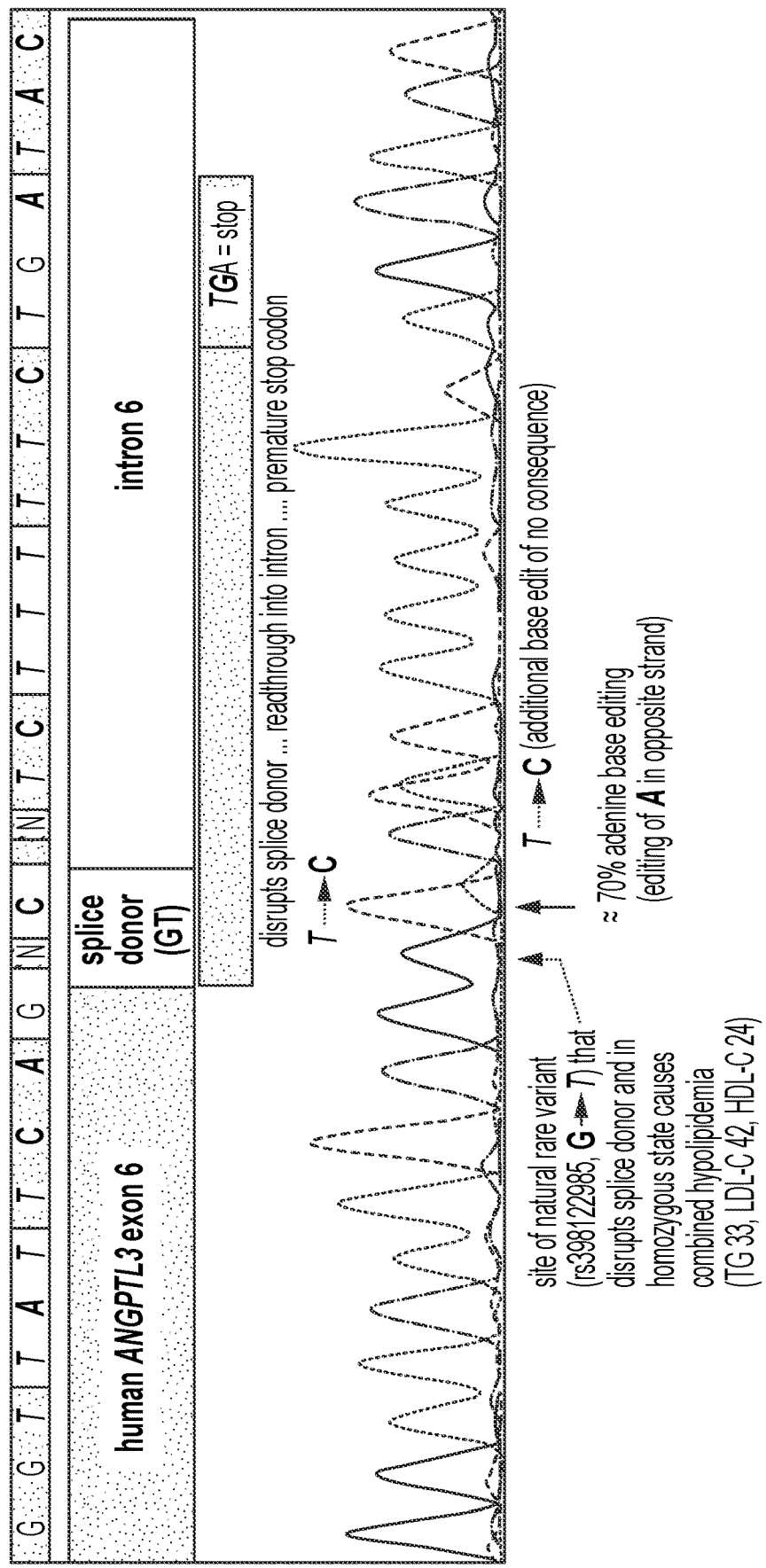
FIG. 10 depicts a Sanger sequencing chromatogram demonstrating editing of adenine base in the antisense strand at the splice donor at the end of ANGPTL3 exon 6 (PCR amplification from the genomic DNA of the cells transfected with the 2500-ng/mL dose), portraying how splice-site disruption results in an in-frame stop codon. A-to-G base editing effected by an adenosine base editor system in modifying ANGPTL3 in primary human hepatocytes.

Editing of ANGPTL3 by ABE8.8 was observed in primary hepatocytes. ANGPTL3 gRNAs were co-transfected with an equivalent amount of in vitro transcribed ABE8.8 mRNA MA004 (1:1 ratio by weight) into primary hepatocytes and processed as described in detailed methods. A human ANGPTL3-targeting gRNA matching the following protospacer sequence 5'-AAGATACCTGAATAACCCTC-3' (SEQ ID NO: 15) (GA091) was identified. The GA091 sequence targets the splice donor at the 5' end of human ANGPTL3 intron 6 and is predicted to result in an aberrant ANGPTL3 protein translated from exons 1, 2, 3, 4, 5, and 6, followed by several amino acids translated from the beginning of intron 6 (readthrough from exon 6 into intron 6), followed by a premature stop codon (FIG. 10). Notably, there is a naturally occurring rare human DNA variant that disrupts the same splice donor and bears the designation rs398122985. A gRNA was synthesized with the orthologous cynomolgous spacer sequence, differing by 1 nucleotide: 5'-AAGATACCTGAATAACTCTC-3' (SEQ ID NO: 14) (GA067) and bearing modest chemical modifications (Table 1). Both GA091 in human primary hepatocytes, and GA067 in cynomolgus primary hepatocytes, lead to substantial splice editing when co-transfected with ABE8.8 mRNA (protocol described in the detailed methods section) (Table 6). RNA was transfected at 2500, 1250, 625, and 312.5 ng/test article/mL, with two replicates reported (rep 1 and rep 2).

TABLE 6

ABE8.8/ANGPTL3 gRNA editing in primary hepatocytes

| gRNA | Species | 2500, rep 1 | 2500, rep 2 | 1250, rep 1 | 1250, rep 2 | 625, rep 1 | 625, rep 2 | 312.5, rep 1 | 312.5, rep 2 |
|---|---|---|---|---|---|---|---|---|---|
| Human Primary Hepatocytes- splice site editing % (Dose, Replicate #) | | | | | | | | | |
| GA091 | Human | 72.23 | 72.04 | 62.01 | 65.15 | 47.85 | 47.3 | 30.71 | 29.62 |
| GA092 | Human/Cyno | 38.39 | 41.71 | 33.38 | 29.83 | 20.73 | 19.94 | 8.54 | 10.92 |
| GA093 | Human | 63.53 | 66.9 | 55.54 | 56.2 | 39.22 | 39.8 | 20.7 | 17.32 |
| GA094 | Human | 44.84 | 46.65 | 39.62 | 46.8 | 28.75 | 14.74 | 14.12 | 26.7 |
| Cyno Primary Hepatocytes- splice site editing (Dose, Replicate #) | | | | | | | | | |
| GA067 | Cyno | 66.06 | 64.84 | 64.92 | 63.78 | 53.56 | 53.66 | 37.05 | 39.36 |
| GA092 | Human/Cyno | 45.76 | 43.27 | 43 | 44.28 | 32.42 | 32.56 | 25.72 | 19.87 |

Another strategy by which adenine base editors might be used to disrupt gene function is to introduce a missense mutation(s) into the coding region of the gene that results in production of a less functional, or non-functional protein. Guide RNAs targeting protospacers in ANGPTL3 exons were assessed for base editing activity to introduce missense mutation(s). Each of the gRNAs with an equivalent amount of in vitro transcribed ABE8.8 mRNA MA004 (1:1 ratio by weight) were co-transfected in two replicates (rep 1 and rep 2) at 2500, 1250, 625, and 312.5 ng/RNA/mL into primary human hepatocytes and processed as described in detailed methods. The resulting base editing efficiency, as well as one potential amino acid substitution, is listed in Table 7.

In some embodiments, adenine base editors disrupts gene function by replacing any one amino acid selected from A, R, N, D, C, Q, E, G, H, I, L, K, M, F, P, S, T, W, Y, and V with a non-identical amin acid A, R, N, D, C, Q, E, G, H, I, L, K, M, F, P, S, T, W, Y, and V. In some embodiments, adenine base editors disrupt gene function by substituting I with T or V. In some embodiments, adenine base editors disrupt gene function by substituting D with G. In some embodiments, adenine base editors disrupt gene function by substituting E with G. In some embodiments, adenine base editors disrupt gene function by substituting F with L or P. In some embodiments, adenine base editors disrupt gene function by substituting H with R. In some embodiments, adenine base editors disrupt gene function by substituting L with P. In some embodiments, adenine base editors disrupt gene function by substituting S with P. In some embodiments, adenine base editors disrupt gene function by substituting M with T. In some embodiments, adenine base editors disrupt gene function by substituting N with G. In some embodiments, adenine base editors disrupt gene function by substituting Q with R. In some embodiments, adenine base editors disrupt gene function by substituting R with G. In some embodiments, adenine base editors disrupt gene function by substituting T with A. In some embodiments, adenine base editors disrupt gene function by substituting V with A. In some embodiments, adenine base editors disrupt gene function by substituting Y with C or H. In some embodiments, adenine base editors disrupt gene function by substituting K with G. In some embodiments, adenine base editors disrupt gene function by introducing an amino acid substitute as listed in Table 7.

TABLE 7

ANGPTL3 gRNA ABE editing can introduce missense mutations

| gRNA | Protospacer (5'-3') | SEQ ID NO | Amino Acid Substitution | Human Primary Hepatocytes- Editing % (Dose, Replicate #) | | | | | | | |
|---|---|---|---|---|---|---|---|---|---|---|---|
| | | | | 2500, rep 1 | 2500, rep 2 | 1250, rep 1 | 1250, rep 2 | 625, rep 1 | 625, rep 2 | 312.5, rep 1 | 312.5, rep 2 |
| GA104 | TAATTTGGCCCTTCGTCTTA | 102 | I68T | 0.27 | 0.31 | 0.17 | 0.29 | 0.27 | 0.31 | 0.21 | 0.27 |
| GA105 | AGACTTTGTCCATAAGACGA | 103 | D59G | 1.12 | 1.06 | 0.98 | 1 | 0.95 | 1.28 | 1.07 | 1.01 |

TABLE 7-continued

ANGPTL3 gRNA ABE editing can introduce missense mutations

| gRNA | Protospacer (5'-3') | SEQ ID NO | Amino Acid Substitution | Human Primary Hepatocytes-Editing % (Dose, Replicate #) | | | | | | | |
|---|---|---|---|---|---|---|---|---|---|---|---|
| | | | | 2500, rep 1 | 2500, rep 2 | 1250, rep 1 | 1250, rep 2 | 625, rep 1 | 625, rep 2 | 312.5, rep 1 | 312.5, rep 2 |
| GA106 | GACTTTGTCCATAAGACGAA | 104 | N/A (D59G) | 1.24 | 1.08 | 1.15 | 1.13 | 1.28 | 1.24 | 1.07 | 1.34 |
| GA112 | ATTGTCTTGATCAATTCTGG | 110 | N/A | 0.53 | 0.44 | 0.46 | 0.54 | 0.49 | 0.35 | 0.39 | 0.5 |
| GA113 | ATTCTGGAGGAAATAACTAG | 111 | S17P | 1.22 | 1.31 | 1.17 | 1.26 | 1.23 | 1.19 | 1.21 | 1.13 |
| GA115 | AACATAGCAAATCTTGATTT | 113 | M39T | 58.3 | ND | 50.19 | ND | 29.1 | ND | 16.55 | ND |
| GA116 | GTAGAATTTTTCTTCTAGG | 114 | I132T | 54.78 | ND | 65.37 | ND | 33.93 | ND | 19.8 | ND |
| GA117 | ACTACAAGTCAAAAATGAAG | 115 | Q107R | 56.95 | 57.99 | 42.71 | 48.24 | 25.63 | 27.9 | 13.13 | 12.8 |
| GA118 | TATATTGGTCTTCCACGGTC | 116 | Y186C | 37.26 | 37.2 | 30.38 | 30.76 | 20.85 | 20.44 | 9.23 | 11.01 |
| GA119 | CAAAGACCTTCTCCAGACCG | 117 | D177G | 54.92 | 55.55 | 14.06 | 42.4 | 25.96 | 25.9 | 10.84 | 12.43 |
| GA120 | GGTCTTCCACGGTCTGGAGA | 118 | V182A | 1.79 | 2.04 | 1.41 | 1.59 | 1.21 | 0.89 | 0.73 | 0.76 |
| GA121 | TTGTTTATATTGGTCTTCCA | 119 | Y186H | 57.04 | 65.91 | 45.78 | 45.61 | 30.15 | 33.83 | 15.68 | 13.37 |
| GA122 | CTTTTATTTGACTATGCTGT | 120 | I196T | 40.76 | 37.69 | 37.03 | 34.27 | 21.08 | 18.83 | 11.25 | 7.49 |
| GA123 | AAAGTCTGGATATAGAGAGT | 121 | F167L | 12.51 | 13.68 | 8.79 | 12.05 | 8.1 | 5.76 | 3.63 | 2.83 |
| GA124 | GTTGGTTTAATTGTTTATAT | 122 | L189P | 4.43 | 4.46 | 4.13 | 4.34 | 2.5 | 2.4 | 1.2 | 0.71 |
| GA125 | TGATGGTAAGACACTTTGGT | 123 | N/A | 23.46 | 26.03 | 20.98 | 24.59 | 13.15 | 15.36 | 6.44 | 5.84 |

TABLE 7-continued

ANGPTL3 gRNA ABE editing can introduce missense mutations

| gRNA | Protospacer (5'-3') | SEQ ID NO | Amino Acid Substitution | Human Primary Hepatocytes- Editing % (Dose, Replicate #) | | | | | | | |
|---|---|---|---|---|---|---|---|---|---|---|---|
| | | | | 2500, rep 1 | 2500, rep 2 | 1250, rep 1 | 1250, rep 2 | 625, rep 1 | 625, rep 2 | 312.5, rep 1 | 312.5, rep 2 |
| GA126 | GGAGTAGTTCTTGGTGCTCT | 124 | N/A | 30.93 | 32.19 | 18.11 | 28.57 | 15.14 | 14.56 | 7.37 | 5.22 |
| GA127 | AACATGATGGTAAGACACTT | 125 | H239R | 43.8 | 45.03 | 35.09 | 34.98 | 23.07 | 24.46 | 12.12 | 12.5 |
| GA128 | TGAAGAAAGGGAGTAGTTCT | 126 | F228P, L229P | 57.41 | 74.82 | 54.67 | 60.9 | 34.35 | 48.55 | 22.73 | 17.55 |
| GA129 | AGTTCTTGGTGCTCTTGGCT | 127 | N/A | 0.19 | 0.07 | 0.07 | 0.13 | 0.05 | 0.11 | 0.1 | 0.08 |
| GA130 | ATGATGGTAAGACACTTTGG | 128 | D240G | 22.16 | 22.73 | 18.57 | 20.93 | 10.79 | 10.52 | 5.93 | 5.09 |
| GA131 | GAAGATAGAGAAATTTCTGT | 129 | L216P, S217P | 73.63 | 82.24 | 65.4 | 74.19 | 42.42 | 47.99 | 25.24 | 27.14 |
| GA132 | GGAAGATAGAGAAATTTCTG | 130 | S217P | 76.43 | 88.77 | 69.65 | 70.55 | 49.49 | 46.32 | 22.36 | 23.83 |
| GA133 | TATTTCATTCAACTGAAGAA | 131 | I234T | 33.9 | 31.49 | 26.95 | 30.48 | 14.09 | 21.88 | 12.1 | 11.31 |
| GA134 | ATTTCATTCAACTGAAGAA | 132 | N/A | 41.07 | 47.04 | 38.09 | 38.78 | 24.71 | 21 | 15.48 | 15.68 |
| GA135 | GTCTACTGTGATGTTATATC | 133 | Y273C | 34.5 | 36.73 | 31.33 | 31.88 | 19.77 | 19.85 | 12.12 | 10.61 |
| GA136 | TAAATGGTGGTACATTCAGC | 134 | I249T | 31.45 | 31.46 | 22.08 | 22.42 | 12.96 | 13.18 | 6.23 | 5 |
| GA137 | TATCAGGTAAAACCTGTCTA | 135 | N/A | 39.23 | 45.5 | 35.54 | 35.24 | 20.93 | 15.07 | 10.3 | 9.13 |
| GA138 | TGTACCACCATTTATAACAG | 136 | T247A | 38.65 | 38.24 | 29.16 | 29.42 | 19.7 | 17.09 | 10.32 | 8.59 |
| GA139 | TTCACCTCTGTTATAAATGG | 137 | N/A | 13 | 11.96 | 10.47 | 9.45 | 6.86 | 4.95 | 3.51 | 3.78 |

TABLE 7-continued

ANGPTL3 gRNA ABE editing can introduce missense mutations

| gRNA | Protospacer (5'-3') | SEQ ID NO | Example Amino Acid Substitution | Human Primary Hepatocytes- Editing % (Dose, Replicate #) | | | | | | | |
|---|---|---|---|---|---|---|---|---|---|---|---|
| | | | | 2500, rep 1 | 2500, rep 2 | 1250, rep 1 | 1250, rep 2 | 625, rep 1 | 625, rep 2 | 312.5, rep 1 | 312.5, rep 2 |
| GA140 | AACAGAGGTGAACATACAAG | 138 | R252G | 30.27 | 41.96 | 32.49 | 33.65 | 18.78 | 17.9 | 9.48 | 7.7 |
| GA141 | TTGAGAGTTGCTGGGTCTGA | 139 | S267P | 0.4 | 0.41 | 0.37 | 0.51 | 0.4 | 0.67 | 0.44 | 0.45 |
| GA143 | TTAATTCAACATCGAATAGA | 141 | I285V | 12.33 | 10.68 | 9.23 | 8.81 | 5.47 | 4.63 | 3.05 | 2.94 |
| GA144 | TTTGGGAGGCTTGATGGTAA | 142 | R308G | 15.05 | 15.17 | 10.82 | 12.69 | 7.52 | 8.04 | 4.16 | 4.56 |
| GA145 | CATTATATTCAGGTAGTCCA | 143 | N/A (intron) | 66.32 | 62.98 | 55.96 | 58.5 | 37.77 | 37.26 | 20.55 | 17.46 |
| GA146 | TTGGGAGGCTTGATGGTAAG | 144 | R308G | 22.26 | 23.4 | 16.22 | 18.81 | 9.91 | 10.61 | 4.57 | 4.62 |
| GA147 | TTTTGGGAGGCTTGATGGTA | 145 | R308G | 3.99 | 3.67 | 3.46 | 2.72 | 1.96 | 2.41 | 1.03 | 1.2 |
| GA148 | ACAAAACTTCAATGAAACGT | 146 | N294G | 25.08 | 21.83 | 22.57 | 21.33 | 12.96 | 16.13 | 8.62 | 7.59 |
| GA149 | TATGGTTTTGGGAGGCTTGA | 147 | Y304C | 0.47 | 0.43 | 0.42 | 0.48 | 0.52 | 0.47 | 0.45 | 0.47 |
| GA150 | ACTACAAATATGGTTTTGGG | 148 | Y302C, K303G | 51.08 | 51.83 | 40.09 | 43.73 | 23.76 | 22.55 | 10.14 | 9.52 |
| GA151 | GAGAACTACAAATATGGTTT | 149 | N301G | 45.3 | 44.63 | 31.68 | 35.7 | 22.72 | 20.85 | 10.83 | 12.4 |
| GA152 | AGGACACTTCAACTGTCCAG | 150 | H391R | 15.32 | 14.78 | 9.37 | 11.5 | 6.33 | 6.89 | 4.95 | 4.38 |
| GA153 | CTTTTCAGGAGAATTTTGGT | 101 | N/A (intron) | 22.82 | 23.57 | 18.25 | 16.17 | 8.41 | 7.17 | 4.79 | ND |
| GA276 | ACGTGGGAGAACTACAAATA | 242 | E300G | 4.85 | 5.62 | 3.78 | 4 | 2.98 | 2.75 | 2.38 | 1.96 |

TABLE 7-continued

ANGPTL3 gRNA ABE editing can introduce missense mutations

| | | | Example | Human Primary Hepatocytes-Editing % (Dose, Replicate #) | | | | | | | |
|---|---|---|---|---|---|---|---|---|---|---|---|
| gRNA | Protospacer (5'-3') | SEQ ID NO | Amino Acid Substitution | 2500, rep 1 | 2500, rep 2 | 1250, rep 1 | 1250, rep 2 | 625, rep 1 | 625, rep 2 | 312.5, rep 1 | 312.5, rep 2 |
| GA277 | CGATGTTGAATTAATGTCCA | 243 | N/A | 2.36 | 2.43 | 1.69 | 1.87 | 1.53 | 1.72 | 1.16 | 1.17 |
| GA278 | CACAAAACTTCAATGAAACG | 244 | Q293R | 4.09 | 4.48 | 2.43 | 2.81 | 2.2 | 2.01 | 1.68 | 1.74 |
| GA279 | TACGAATTGAGTTGGAAGAC | 245 | I333V | 22.69 | 29.48 | 19.35 | 21.19 | 12.41 | 15.31 | 7.23 | 7.37 |
| GA284 | CTATGGAGTATATCTTCTCT | 246 | S322P | 22.78 | 30.95 | 22.27 | 19.12 | 16.01 | 16.29 | 11.29 | 5.95 |

The gRNAs GA066/GA095, GA096, G097, GA346, matching the 5'-CCCGCACCTTGGCGCAGCGG-3' (SEQ TD NO: 13) (GA066) protospacer sequence but with more extensive chemical modifications of various kinds (Table 1) were synthesized. Similarly, three gRNAs (GA098, GA099, GA100) were synthesized matching the 5'-AAGATACCTGAATAACCCTC-3' (SEQ TD NO: 15) (GA091) human protospacer sequence, as well as four gRNAs (GA067/GA101, GA 102, GA 103, GA347) matching the 5'-AAGATACCTGAATAACTCTC-3' (SEQ TD NO: 14) (GA067) cynomolgus protospacer sequence, but with more extensive chemical modifications of various kinds (Table 1). GA066 and GA095 contain the same chemical composition and modification pattern, as do GA067 and GA101 with one another. It is contemplated that such gRNAs may improve stability against nucleases and gRNA-base editor complex, and reduce or suppress gRNA-triggered immune reaction.

Each of the gRNAs described in Table 8, with an equivalent amount of in vitro transcribed ABE8.8 mRNA MA002 (1:1 ratio by weight), were co-transfected into primary human hepatocytes and primary cynomolgus hepatocytes via MessengerMax reagent, using various dilutions to assess for editing activity at different concentrations of test article. Three days after transfection, genomic DNA was harvested from the hepatocytes, and then assessed for base editing of the target splice site with next-generation sequencing. In both human and cynomolgus hepatocytes, as high as 60%-70% editing of the target splice site (PCSK9 intron 1 splice donor; ANGPTL3 intron 6 splice donor) were observed (Table 8).

TABLE 8

Chemically modified gRNAs have high editing efficiency in human and cynomolgus primary hepatocytes

| | | Human Primary Hepatocytes-splice site editing % | | | | Cynomolgus Primary Hepatocytes-splice site editing % | | | |
|---|---|---|---|---|---|---|---|---|---|
| gRNA | Species | 2500 ng/mL | 500 ng/mL | 100 ng/mL | 20 ng/mL | 2500 ng/mL | 500 ng/mL | 100 ng/mL | 20 ng/mL |
| GA066 | Human/Cyno | 67.7 | 55.1 | 38.9 | 13.3 | 48.2 | 55.3 | 43.8 | 19.0 |
| GA096 | Human/Cyno | 62.8 | 49.9 | 41.2 | 15.6 | 65.9 | 51.4 | 48.0 | 19.6 |
| GA097 | Human/Cyno | 67.3 | 68.1 | 54.1 | 22.6 | 62.2 | 58.1 | 56.8 | 28.0 |
| GA098 | Human | 70.7 | 51.3 | 36.3 | 10.9 | ND | ND | ND | ND |
| GA099 | Human | 70.3 | 47.0 | 34.4 | 11.5 | ND | ND | ND | ND |
| GA100 | Human | 69.2 | 48.6 | 38.5 | 12.4 | ND | ND | ND | ND |
| GA066/GA101 | Cyno | ND | ND | ND | ND | 61.4 | 49.0 | 45.9 | 16.0 |
| GA102 | Cyno | ND | ND | ND | ND | 62.5 | 51.7 | 58.1 | 25.9 |
| GA103 | Cyno | ND | ND | ND | ND | 62.7 | 44.2 | 44.6 | 17.2 |

Figure 11:
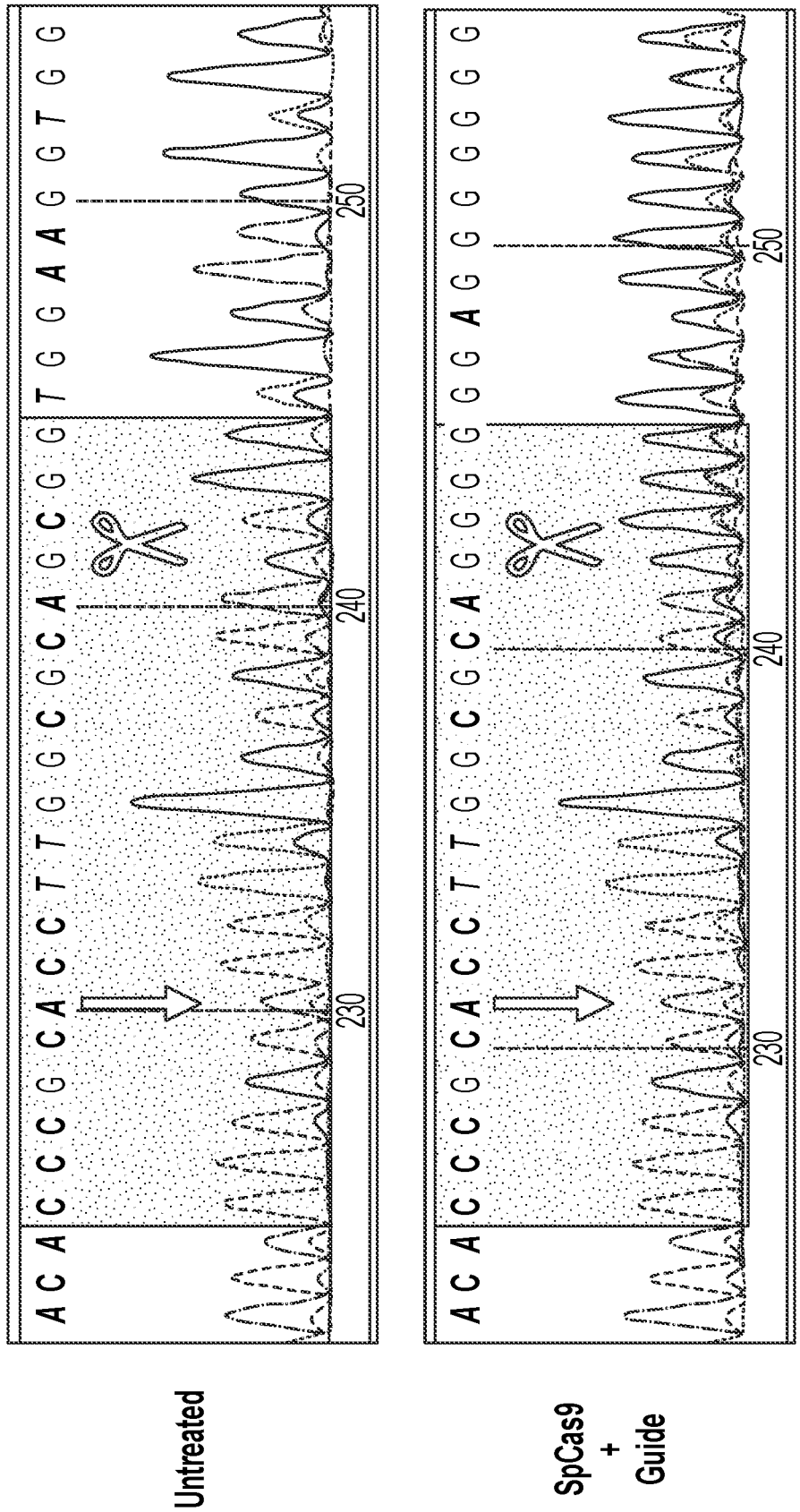
FIG. 11 shows three sanger sequencing chromatograms from PCR amplified genomic DNA isolated from: 1) untreated primary hepatocytes (top panel); 2) SpCas9 mRNA/PCSK9 gRNA GA097 treated primary hepatocytes (middle panel); 3) ABE8.8 mRNA/PCSK9 gRNA treated primary hepatocytes (bottom panel). The PCSK9-gRNA GA097 protospacer sequence is highlighted in grey. The arrow points to the position 6 of the protospacer that is targeted for A-to-G base editing by the ABE8.8 editor. The scissors depict the general site of double stranded break that occurs upon cutting by the SpCas9 nuclease at this target site. SpCas9 mRNA and GA097 delivery in cells resulted in significant gene editing at the site of the double strand break (as denoted with the scissors) but this was not seen in the ABE8.8 and GA097 delivery in cells. Instead, the same gRNA GA097 in combination with ABE8.8 mRNA resulted in robust A-to-G base editing.
Figure 11:
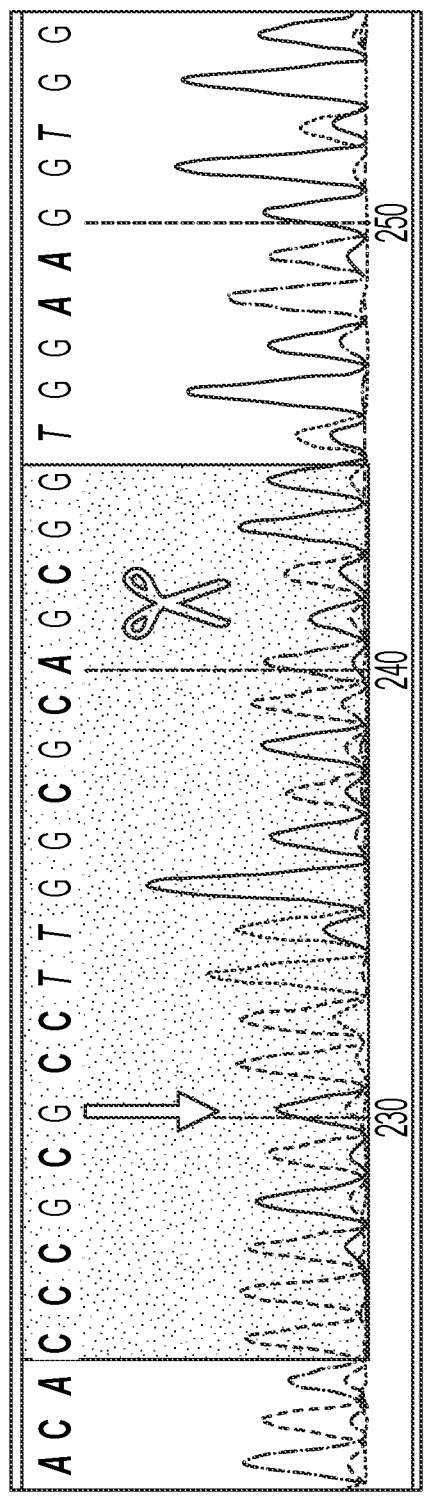

The method by which classical CRISPR/Cas9 disrupts a gene by ultimately introducing an indel, is distinctly and significantly different than base editing. Specifically, base editing is used to introduce a base mutation(s) within a target window closer to the 5' region of the protospacer, as opposed to 3-4 bp away from the PAM, as routinely seen with CRISPR/Cas9. Further, a target region that is highly amenable to CRISPR/Cas9 editing does not necessarily mean base editing at that location will occur, and vice versa. LNPs containing either: (1) Cas9 mRNA MS010 and a gRNA matching 5'-CCCGCACCTTGGCGCAGCGG-3' (SEQ ID NO: 13) (GA097) protospacer sequence; or (2) ABE8.8 mRNA MA004 and gRNA matching 5'-CCCGCACCTTGGCGCAGCGG-3' (SEQ ID NO: 13) (GA097) protospacer sequence, were transfected in human primary hepatocytes. Sanger sequencing of the edited genomic DNA was performed and illustrated the difference in gene editing that occurred from CRISPR/Cas9 compared to base editing (FIG. 11). The arrow highlights the main base editing position, while the scissors highlight the general region where Cas9 cuts.

Figure 12:
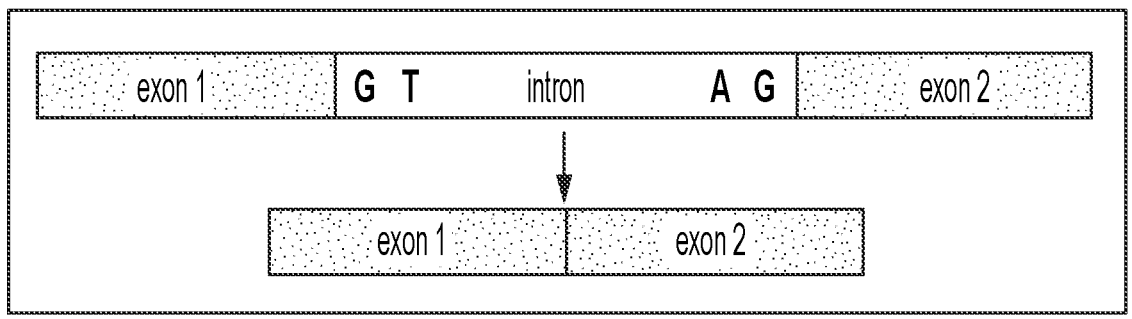
FIG. 12 depicts a schematic showing potential splicing outcomes with disruption of splice donor or splice acceptor sequences. Other outcomes are possible, such as inclusion of part of intron 1 in the splicing product. Alteration of the splice donor or splice acceptor sites are shown (top panel). Alternative splice donor sites within PCSK9 intron 1 resulting from editing of PCSK9 exon 1 splice-donor adenine base in primary human hepatocytes is shown in the bottom panel. *Four different primer pairs (Table 9) were used for RT-PCR of the control/treated samples.
Figure 12:
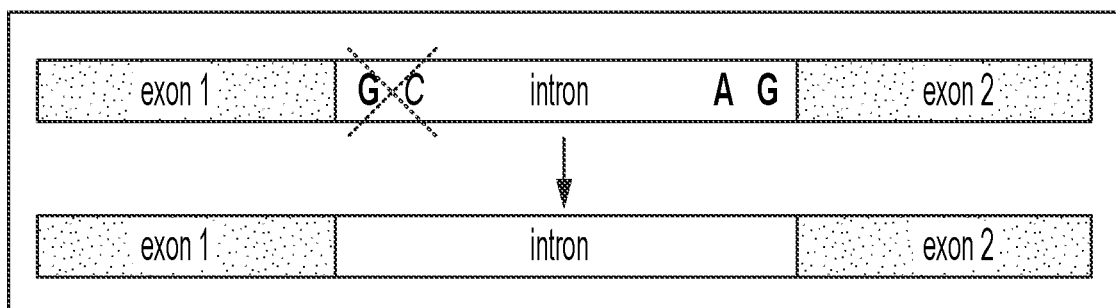
Figure 12:
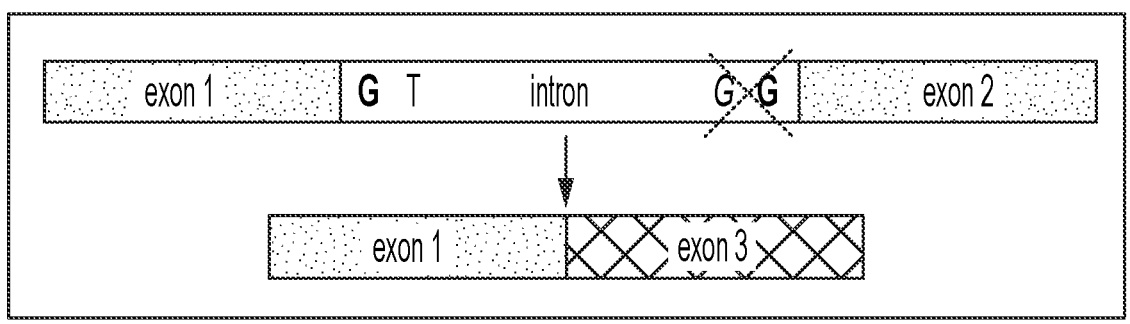
Figure 12:
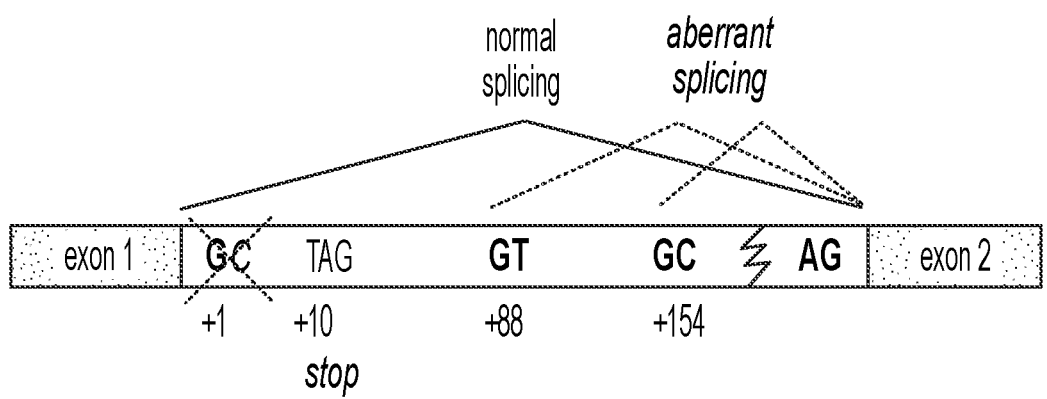

To demonstrate that base editing of a splice site disrupts splicing, reverse transcription-PCR of mRNA from treated primary human hepatocytes, using primers in exon 1 and exon 2, was performed. Results confirmed that splice site disruption resulted in the use of alternative splice donor sites within intron 1, well downstream of the in-frame TAG stop codon (FIG. 12, Table 9). The table reports the number of mapped reads for each splice site donor as determined from next generation sequencing.

The second method to generate candidate sites used an in vitro biochemical assay, ONE-seq, that determined the propensity of a ribonucleoprotein comprising the ABE8.8 base editor protein and PCSK9 gRNA (5'-CCCGCACCTTGGCGCAGCGG-3'(SEQ ID NO: 13)) to cleave oligonucleotides in a library. The reference human genome (GRCh38) was searched for sites with up to 6 mismatches to the protospacer sequence specified by the PCSK9 gRNA (5'-CCCGCACCTTGGCGCAGCGG-3' (SEQ ID NO: 13)), and sites with up to 4 mismatches plus up to 2 DNA or RNA bulges using Cas-Designer were identified. More specifics on ONE-seq library preparation, experimental protocol, and bioinformatic analysis are described in the additional detailed methods section.

Any cleaved oligonucleotides are PCR-amplified and undergo next-generation sequencing. Oligonucleotides with higher sequence counts reflect a higher propensity for Cas9/gRNA cleavage in vitro and represent the sites most likely to suffer off-target mutagenesis in cells. The top site identified by the ONE-seq assay was the on-target PCSK9 site. The list of candidate off-target sites comprises more than 250 sites, and warranted further investigation (Table 10).

Primary human hepatocytes were treated with lipid nanoparticle (LNP) encapsulating ABE8.8 mRNA MA004 and PCSK9 gRNA (GA097 or GA346) at 1:1 weight ratio (see Lipid Nanoparticle Formulation and Analysis for details of LNP preparation) Upon next-generation sequencing using

TABLE 9

Alternative splice donor sites within PCSK9 intron 1 resulting from editing of PCSK9 exon 1 splice-donor adenine base in primary human hepatocytes.

| Sample* | Mapped reads | Number of aligned reads corresponding to: | | | | | |
|---|---|---|---|---|---|---|---|
| | | Intron length 0 (GT donor) | Intron length 83 (CC donor) | Intron length 87 (GT donor) | Intron length 135 (CG donor) | Intron length 153 (GC donor) | Intron length 154 (CA donor) |
| control (1) | 7827 | 3187 | 0 | 0 | 0 | 0 | 0 |
| control (2) | 10584 | 5956 | 0 | 0 | 0 | 0 | 0 |
| control (3) | 8575 | 2307 | 0 | 0 | 0 | 0 | 0 |
| control (4) | 6721 | 5153 | 0 | 0 | 0 | 0 | 0 |
| treated (1) | 8278 | 2368 | 0 | 243 | 184 | 984 | 0 |
| treated (2) | 4127 | 1851 | 19 | 235 | 0 | 785 | 0 |
| treated (3) | 5694 | 1096 | 21 | 563 | 0 | 392 | 130 |
| treated (4) | 4214 | 2036 | 0 | 70 | 0 | 1203 | 0 |

*Four different primer pairs were used for RT-PCR of the control/treated samples.

Example 4. PCSK9 and ANGPTL3 Off-Target Validation In Vitro

With a view towards establishing the safety of a base-editing therapy knocking down PCSK9 in the human liver in vivo, off-target mutagenesis analysis was assessed. A list of candidate sites in the human genome for off-target mutagenesis was assembled using two different methods. The first method used bioinformatic analysis of the human genome, identifying all sites with a PAM sequence compatible with *Streptococcus pyogenes* Cas9 (and therefore ABE 8.8) and a protospacer sequence with up to 4 single-nucleotide mismatches with the GA066 spacer sequence 5'-CCCGCACCTTGGCGCAGCGG-3' (SEQ ID NO: 13).

the Agilent SureSelect technology (Table 11), when the observed base editing rates in control cells were subtracted from the observed base editing rates in LNP-treated cells across the on-target site and candidate off-target sites (to account for background sequencing errors inherent in next-generation sequencing), appreciable base editing was observed at the on-target PCSK9 target site. These results were replicated in three different primary hepatocyte lots (STL, HLY, and JLP) from two male and one female patients.

Figure 13:
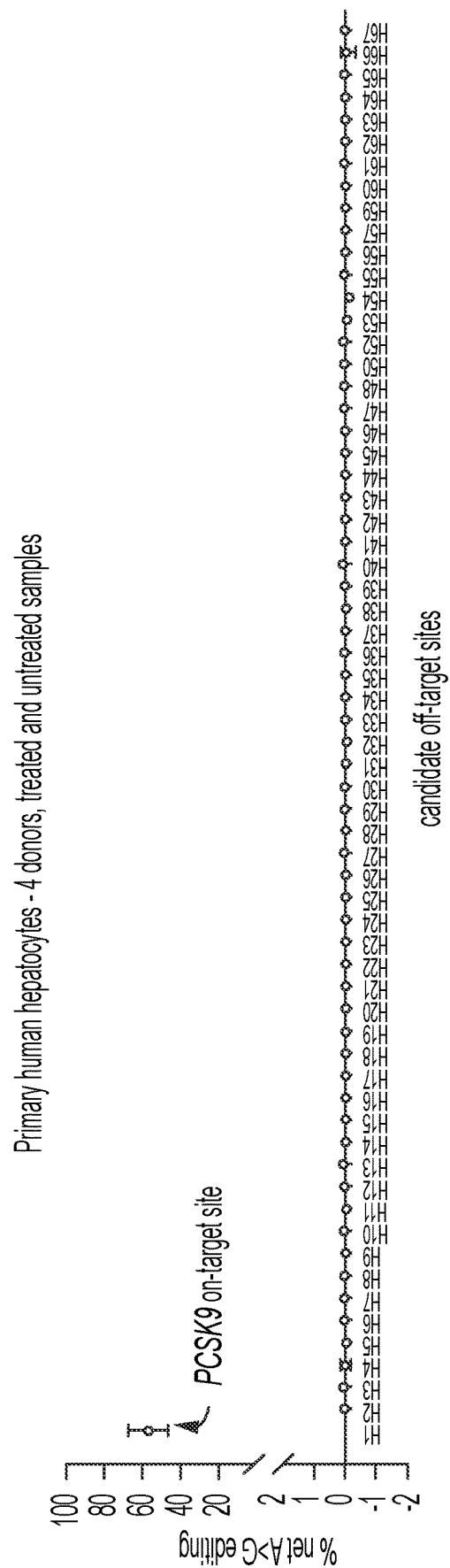
FIG. 13 shows lack of guide RNA-dependent DNA off-target editing in primary human hepatocytes. Human primary hepatocytes were incubated with gRNA (GA097 or GA346) and ABE8.8 mRNA as described in Example 4. The off-target reading was calculated as net adenine editing (proportion of sequencing reads with alteration of one or more adenine bases in LNP-treated cells versus untreated cells) at the on-target PCSK9 site and more than 50 candidate off-target PCSK9 sites in primary human hepatocytes from four individual donors.

Additionally, using hepatocytes from four individual donors (including lot TLY from a female patient, in addition to the three lots listed above), more than 50 off-target sites were assessed by performing next-generation sequencing of targeted PCR amplicons from LNP-treated versus untreated hepatocytes. Editing at none of these potential off-target sites, and only on-target editing at the PCSK9 target site, was observed (FIG. 13).

TABLE 10

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 1 | 55040029-55040051 | CCCGCACCTTGGCGCAGCGGTGG | 80 | X00 |
| 1 | 6888039-6888061 | CTAGCACC-TGCCCCAGCGGTGG | 453 | RNA41 |
| 1 | 10640222-10640244 | TCCCTACCCTGGCACAGCAGGGG | 454 | X60 |
| 1 | 15101074-15101096 | CCCACACTCAGACGCAGCGAGGG | 455 | X60 |
| 1 | 20712184-20712206 | CCCGCAC--TGGAGCAGCAGGGA | 456 | RNA32 |
| 1 | 22256342-22256365 | CTTGCACCTTGGTAGCAGCTGGGG | 457 | DNA41 |
| 1 | 25103342-25103364 | CTGGCACCATGGCCCAGCAGTGG | 458 | X50 |
| 1 | 29882027-29882049 | ACTGCATCTTAGTGCAGAGGTGG | 459 | X60 |
| 1 | 40866872-40866894 | TCCACACCTTGGCGCACTGGAAG | 460 | X50 |
| 1 | 43692630-43692652 | CATTCACCTTGTCACAGCTGGGG | 461 | X60 |
| 1 | 44163492-44163514 | ACCGCACCATTGCACAGCCTAGG | 462 | X60 |
| 1 | 54256943-54256966 | GCCGCACCATGGGCACAGCGGGGA | 463 | DNA41 |
| 1 | 60335313-60335335 | CCCATACC-TGGCACAGCGGTGG | 464 | RNA31 |
| 1 | 64198527-64198549 | CAAGCACC-TGGCTCAGAGGTGG | 465 | RNA41 |
| 1 | 64266524-64266546 | ACCGCACC-TGGCACAGTGGAAG | 466 | RNA41 |
| 1 | 110096163-110096185 | CCCCACCCTTGGCACAGAGCAGG | 467 | X60 |
| 1 | 121262583-121262605 | CCAGCACC-TAGCGCAGAGCTGG | 468 | RNA41 |
| 1 | 145017699-145017721 | CCAGCACC-TAGCGCAGAGCTGG | 468 | RNA41 |
| 1 | 155615561-155615583 | CCCGCACC-TACCTCAGCAGGGG | 469 | RNA41 |
| 1 | 155751756-155751778 | CCCGCACC-TACCTCAGCAGGGG | 469 | RNA41 |
| 1 | 157194781-157194803 | CCCGCACCCCACCGCAGCGGGGG | 470 | X40 |
| 1 | 163263975-163263997 | TCTTTACCTTGGAGCAGCTGAGG | 471 | X60 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 1 | 175575740-175575762 | CCCGCACCACAGTGCACCGGGGG | 472 | X50 |
| 1 | 204314754-204314776 | CCTCCACAATGGCGCAGGGGCGG | 473 | X50 |
| 1 | 206281058-206281080 | CCAGCACC-TAGCGCAGAGCTGG | 468 | RNA41 |
| 1 | 208574946-208574968 | CCAGCACC-TGGCACAGAAGAGG | 474 | RNA41 |
| 1 | 228337504-228337526 | ACCGCACCAAGGTGCATAGGAGG | 475 | X60 |
| 1 | 240808285-240808307 | CCAGCA-CTTGCCCCAGCAGAGG | 476 | RNA41 |
| 2 | 9138986-9139008 | CTCCCACCCTGGCCCAGCGGGGG | 477 | X40 |
| 2 | 11670027-11670049 | ACAGCACCTTGGCCCAGAGGCGA | 478 | X50 |
| 2 | 15561025-15561047 | ACGGCACCTTGGGCTAGCGGGGG | 479 | X50 |
| 2 | 42969964-42969986 | CCCGCACCCAGCTGCAGCCGAGG | 480 | X50 |
| 2 | 69112187-69112209 | CCAGCACC-TGGTGCAGAGTAGG | 481 | RNA41 |
| 2 | 71667395-71667417 | CCCACACCTGGGCCCAGTGGAGG | 482 | X40 |
| 2 | 72985325-72985347 | CCAGCACC-TGGTGCAGCTTAGG | 483 | RNA41 |
| 2 | 85317392-85317414 | TCCACACAATGGCACAGCAGAGG | 484 | X60 |
| 2 | 90356123-90356145 | CCCGCACC-TGGCTCAGAGGGTC | 485 | RNA41 |
| 2 | 91447288-91447310 | CCCGCACC-TGGCTCAGAGGGTC | 485 | RNA41 |
| 2 | 107914896-107914919 | CGGGCACCATGGCAGCAGCGGAGG | 486 | DNA31 |
| 2 | 110633933-110633956 | CGGGCACCATGGCAGCAGCGGAGG | 486 | DNA31 |
| 2 | 120922089-120922111 | CCCACACCATGGCCCAGTGAGAG | 487 | X60 |
| 2 | 127571237-127571259 | CCAGCACC-TGGCACAGTGAAGG | 488 | RNA41 |
| 2 | 132524147-132524169 | CCCACACATGGCCACAGCAGTGG | 489 | X60 |
| 2 | 179801496-179801518 | CTGGCACCTTAGCACAGAGGAGG | 490 | X50 |
| 2 | 182608809-182608831 | CCCGCACCAGAGCGCAGGGGGAG | 491 | X50 |
| 2 | 197360047-197360069 | GCCACACC-TGGCCCAGCAGGGG | 492 | RNA41 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 2 | 203642814-203642836 | CCCGCACCAGGGCGCAGATGGAG | 493 | X50 |
| 2 | 203866756-203866778 | TCCACACCTCAGCACAGCAGAGG | 494 | X60 |
| 2 | 219451287-219451309 | ACCGCACCTTGGCCCAGTGCTGG | 495 | X40 |
| 2 | 231686140-231686162 | ACCGCAGC-TGGCGCAGCATGGG | 496 | RNA41 |
| 3 | 3719723-3719745 | CCCGCACC-TGGCTCAGAGGGTC | 485 | RNA41 |
| 3 | 10287991-10288013 | CCCGCA-TTTGCCTCAGCGGTGG | 497 | RNA31 |
| 3 | 13178217-13178239 | CCAGCA-CTTGGCACAGCAGTGG | 498 | RNA31 |
| 3 | 14242673-14242696 | CCCACACCTTGGTGTCAGCGGAGG | 499 | DNA21 |
| 3 | 14819436-14819458 | CCTGCACC-CGGAGCAGCAGGGG | 500 | RNA41 |
| 3 | 38369509-38369531 | CCTCCACCTTGGCCCAGTGGAGG | 501 | X40 |
| 3 | 52005791-52005813 | CTCCCACCCTGGCGCAGAGGAGG | 502 | X40 |
| 3 | 54016522-54016544 | TCAGCACC-TGGTGCAGAGGAGG | 503 | RNA41 |
| 3 | 118171416-118171438 | CGAGCACCATGGCGCAGCCCCGG | 504 | X50 |
| 3 | 118171480-118171502 | CCCGCA-CTTGGAGCAGCCGGCG | 505 | RNA31 |
| 3 | 139288546-139288568 | GGAGCACCTTGACCCAGCAGAGG | 506 | X60 |
| 3 | 139677330-139677352 | CCAGCA-CTTAGCCCAGCAGCGG | 507 | RNA41 |
| 3 | 139731008-139731030 | CCCGCACCTCGGCACAGCTAGGG | 508 | X40 |
| 3 | 150408362-150408384 | GCCCCATCTTGGCCCAGCGGAGG | 509 | X40 |
| 3 | 182806878-182806900 | CTAGAACCATGGTGCAGAGGGGG | 510 | X60 |
| 4 | 1221653-1221675 | ATCCCACCTCGGCACAGCTGGGG | 511 | X60 |
| 4 | 1308120-1308142 | CCCGCACCGTGGTACAGCCTGTG | 512 | X60 |
| 4 | 6008382-6008404 | CCCGCACC-AGGCCCAGCTGGCG | 513 | RNA41 |
| 4 | 6747615-6747637 | CCCACACCTTGGTGCAGCTCTGT | 514 | X50 |
| 4 | 7054192-7054214 | ACCACACC-TGTCCCAGCGGAGG | 515 | RNA41 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 4 | 37229056-37229078 | CACACTACTTGGCACAGAGGAGG | 516 | X60 |
| 4 | 84244376-84244398 | ACCGCA-CTCAGAGCAGCGGAGG | 517 | RNA41 |
| 4 | 114598629-114598651 | TCCGCA-CTTGGCTCAGCGGGGC | 518 | RNA31 |
| 4 | 115179695-115179717 | CCCCGCACTCGGAGCAGCGGCGG | 519 | X60 |
| 4 | 139511785-139511808 | TCCGCACCCTGAGAGCAGTGGAGG | 520 | DNA41 |
| 4 | 141615591-141615613 | CCCTGCACTTGGTGCAGCTGGGG | 521 | X60 |
| 4 | 158623208-158623230 | ACCGCACC-TGACCCAGTGGTGG | 522 | RNA41 |
| 4 | 182110224-182110246 | CTCCTACCATGGCACAGCTGAGG | 523 | X60 |
| 5 | 767330-767352 | CCCACACCAGGGCGCAGCTGAAG | 524 | X50 |
| 5 | 1516550-1516572 | CCAGTACCTTGGCCCAGCTTTGG | 525 | X50 |
| 5 | 77203454-77203476 | ACAGCACC-TGGCACAGTGGTGG | 526 | RNA41 |
| 5 | 126364896-126364918 | CCCACACC-TGGAGCACCAGGGG | 527 | RNA41 |
| 5 | 126628420-126628443 | CAAGCACCTTGGCAGCAGCTGAGG | 528 | DNA31 |
| 5 | 173667321-173667343 | CCCATGCCTTAGCACAGCGATGG | 529 | X60 |
| 5 | 178526685-178526707 | CTCTATCCTTGGCCCAGCAGTGG | 530 | X60 |
| 6 | 3751269-3751291 | CCCGCACCTTGCCGCAGCGGCCC | 531 | X30 |
| 6 | 15092621-15092643 | ATGGCACCTTGGCACATCAGAGG | 532 | X60 |
| 6 | 16346963-16346985 | CCCCGCACTCGGAGCAGCGGCGG | 519 | X60 |
| 6 | 29016770-29016792 | TCCCCACACTGTCGCAGAGGAGG | 533 | X60 |
| 6 | 36310604-36310626 | CCAGCACCATGGCACAGAGAGGT | 534 | X60 |
| 6 | 44047493-44047515 | ACAGCACC-TGGCACAGAGGAGG | 535 | RNA41 |
| 6 | 47477658-47477680 | ACCGCACCTGGCAGCAGCCGTGG | 536 | X50 |
| 6 | 73315113-73315135 | CCAGCACC-TGGAGCAGCCGAGG | 537 | RNA31 |
| 6 | 138138382-138138404 | CCAGCACC-TGGCACAAAGGAGG | 538 | RNA41 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 6 | 139537177-139537199 | GAGGCACCTTGGACCAGCAGCGG | 539 | X60 |
| 6 | 148698322-148698344 | CCCGCA-CTTGGAGCAGCCGGTG | 540 | RNA31 |
| 6 | 153756217-153756239 | CCAGCA-CTTAGTGCAGCGCAGG | 541 | RNA41 |
| 6 | 165843913-165843935 | CCCACACC-TGGAGCAGCAGGAG | 542 | RNA41 |
| 7 | 93102-93124 | CCCACACC-AGGCACGGCGGGGG | 543 | RNA41 |
| 7 | 5360719-5360741 | CCCTCACC-AGCCGCAGCAGGGG | 544 | RNA41 |
| 7 | 24849083-24849106 | CACCCGACTTGGCGACAGCGGGGG | 545 | DNA41 |
| 7 | 74043103-74043125 | ACCGCACC-TGGCACAGAAGGGG | 546 | RNA41 |
| 7 | 84150566-84150588 | CCCGCACC-TGGCTCAGAGGGTC | 485 | RNA41 |
| 7 | 96041009-96041031 | ACCACACC-TGGCCCAGCAGTGG | 547 | RNA41 |
| 7 | 98765214-98765236 | CCCTCACC-GGGCACAGAGGAGG | 548 | RNA41 |
| 7 | 106882973-106882995 | CCAGTACC-TGGCCCAGAGGAGG | 549 | RNA41 |
| 7 | 123763164-123763186 | CCCGCACC-AGGCGCAGGTGGAG | 550 | RNA41 |
| 7 | 129225099-129225122 | CAGGCACCTTGGCGGCAGCCGCGG | 551 | DNA31 |
| 7 | 139596895-139596917 | TGTGCACCATGGCACAGCGGGGA | 552 | X60 |
| 7 | 147737806-147737828 | CCCGCACC-TGGCTCAGAGGGTC | 485 | RNA41 |
| 7 | 150737589-150737611 | CCCGCACACAGACGCAGAGCAGG | 553 | X60 |
| 7 | 153256176-153256198 | TCCACACC-TGGCCCAGCTGTGG | 554 | RNA41 |
| 7 | 155527865-155527887 | CCTGCAC--TGGCCCAGCAGCGG | 555 | RNA32 |
| 8 | 2485153-2485175 | CCTGCA-CTAGCCGCAACGGGGG | 556 | RNA41 |
| 8 | 26191893-26191915 | TGAGCACCTTGGGGCAGCTGGGG | 557 | X50 |
| 8 | 100957388-100957410 | CCCGCA-CTTGGCGCAGCTGGCC | 558 | RNA31 |
| 8 | 139813559-139813582 | CCAGCACCTTGGCAGCAGCACCGG | 559 | DNA31 |
| 8 | 142499068-142499090 | TCCCCCACTTGGCACAGCTGGGG | 560 | X60 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 8 | 143383198-143383220 | CCAGCA-CAGGGCGCAGAGGTGG | 561 | RNA41 |
| 9 | 33873295-33873317 | CCCACCCCTTAGCACAGCAATGG | 562 | X60 |
| 9 | 34958979-34959001 | CCCACACCGTGGCCCAGAGGTGG | 563 | X40 |
| 9 | 109123571-109123593 | CCAGCACC-TGGCACAGCATAGG | 564 | RNA41 |
| 9 | 137012994-137013016 | ACCACTACCTGGCCCAGCGGTGG | 565 | X60 |
| 9 | 137167999-137168021 | TCCGCACCTTGGTCCAGCAGGGG | 566 | X40 |
| 9 | 137477162-137477184 | TACGCACC-TGGCTCAGCAGAGG | 567 | RNA41 |
| 10 | 1572578-1572600 | AGCCCAGCATGGCGCAGAGGTGG | 568 | X60 |
| 10 | 5824416-5824438 | CCAGCACC-TGGCACAGAGGAGA | 569 | RNA41 |
| 10 | 16285410-16285432 | ACCGCACC-TGGCCCAGATGGGG | 570 | RNA41 |
| 10 | 20297215-20297237 | CCCGCACC-TGGCTCAGAGGGGT | 571 | RNA31 |
| 10 | 21126683-21126705 | ACCGCACC-TGGCCCAGTGGAGG | 572 | RNA31 |
| 10 | 28839554-28839576 | CCCACATCCTGGCCCAGCAGGGG | 573 | X50 |
| 10 | 47223533-47223555 | CCTGCACC-AGGCTCAGTGGGGG | 574 | RNA41 |
| 10 | 59089166-59089189 | CGAGCACCTTGGCAGCAGCTGAGG | 575 | DNA31 |
| 10 | 60958888-60958910 | ACCGCACC-TGGCCCAGAGTAGG | 576 | RNA41 |
| 10 | 88036335-88036357 | ACAGCACC-TGGCGCAGAGCGGG | 577 | RNA41 |
| 10 | 97031490-97031512 | ACTCCACCATGGCACAGCGTGGG | 578 | X60 |
| 10 | 111259337-111259359 | ACCACACC-TGGCCCAGAGGAGG | 579 | RNA41 |
| 10 | 122572126-122572148 | GCGGCACCTTGGCCCAGCGTGGG | 580 | X40 |
| 10 | 130560773-130560795 | CCTGCACCTGAGCACAGAGGAGG | 581 | X50 |
| 11 | 2916587-2916609 | CCCGCACCCT-GTGCAGCCGAGG | 582 | RNA31 |
| 11 | 10630862-10630884 | CCCAC-TCTTGGCACAGGGGAGG | 583 | RNA41 |
| 11 | 18729719-18729741 | CCCGCACC-AGGTGCAGGAGTGG | 584 | RNA41 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 11 | 47350413-47350435 | ACCGCACC-TGGCCCAGCAAAGG | 585 | RNA41 |
| 11 | 47941203-47941225 | GCTGCACCTTAGCACAGTGAAGG | 586 | X60 |
| 11 | 57761981-57762003 | TCAGCACCTTGGCGAAGCCTTGG | 587 | X50 |
| 11 | 72870610-72870632 | ACCGCACC-TGGCCCAAAGGGGG | 588 | RNA41 |
| 11 | 76659109-76659131 | CCCTCACCCTGGCACAGCCGGGG | 589 | X40 |
| 11 | 117692097-117692119 | TTCACACCTTGGTGCAGAGGTGA | 590 | X60 |
| 11 | 121325368-121325390 | CCAGCACC-TAGCGCAGCGGCTG | 591 | RNA31 |
| 11 | 129981605-129981627 | ACCGCACC-TGGCCCATCAGGGG | 592 | RNA41 |
| 12 | 3851459-3851481 | CCCGCACC-TGGCTCAGCGGGTC | 593 | RNA31 |
| 12 | 32850805-32850827 | TCAGCACC-TGGAGCAGCCGAGG | 594 | RNA41 |
| 12 | 48000120-48000142 | CCCCACCCTTGGTGCAGAGGAGG | 595 | X50 |
| 12 | 53328526-53328548 | CATACACCTTGCCGCAGCCAGGG | 596 | X60 |
| 12 | 54190321-54190343 | CACACACCTTAGCACAGCCAAGG | 597 | X60 |
| 12 | 65971780-65971802 | CTAGCACC-TGGCACAGTGGTGG | 598 | RNA41 |
| 12 | 95590363-95590385 | ACCGTACC-TGGCCCAGAGGAGG | 599 | RNA41 |
| 12 | 106690762-106690784 | GCCCACCTTAATGCAGCGGGG | 600 | X50 |
| 12 | 114491014-114491036 | CCAGCTACATGGCCCAGAGGAGG | 601 | X60 |
| 12 | 127431260-127431282 | CCCACACCAT-GCGCAGAGTGGG | 602 | RNA41 |
| 13 | 25788073-25788095 | CCCGCACCCAGGC-CAGCTGTGG | 603 | RNA31 |
| 13 | 69424400-69424422 | CCAGCACC-TGCTGCAGCGATGG | 604 | RNA41 |
| 13 | 85917572-85917594 | CCCGCACC-TGGCTCAGAGGGTC | 485 | RNA41 |
| 13 | 98388403-98388425 | TCCGCACCTTGGCCCAGTTGAAG | 605 | X50 |
| 14 | 20813343-20813366 | ACAGCACCTTGGCAGCAGAGGTGG | 606 | DNA31 |
| 14 | 24408232-24408254 | CCCGCACC-AGGCTCAGCAGCAG | 607 | RNA41 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 14 | 38663021-38663043 | CCAGCACC-TGGCACAGCCAGGG | 608 | RNA41 |
| 14 | 65250553-65250575 | GCTGCACCCTGCCACAGAGGAGG | 609 | X60 |
| 14 | 89310097-89310119 | CCAGCACCCTAGTGCAGAGTGGG | 610 | X60 |
| 14 | 90554536-90554558 | CCCGCACC-TGGCACAGCACCAG | 611 | RNA41 |
| 14 | 100213915-100213937 | CCCG-ACCCTGACGCAGCCTGGG | 612 | RNA41 |
| 14 | 101153383-101153405 | CCCGCACCCTATCACAGCAGAGG | 613 | X50 |
| 14 | 102929418-102929440 | CTCGCACC-AGGCGCAGCCGTGG | 614 | RNA31 |
| 15 | 42252041-42252063 | CCCGCACC-TGGCTCAGCGGGTC | 593 | RNA31 |
| 15 | 47827093-47827115 | CATGTACCTTGCCACAGCAGGGG | 615 | X60 |
| 15 | 69452825-69452848 | CGAGCACCTTGGCGGCAGCTGAGG | 616 | DNA31 |
| 15 | 86059010-86059032 | TCCACACCTAGGCACAGCCTAGG | 617 | X60 |
| 15 | 94089230-94089252 | CCAGCACCAAGGCTCAGCTGAGG | 618 | X50 |
| 15 | 99993270-99993292 | ACCGCACC-TGGCACATTGGAGG | 619 | RNA41 |
| 16 | 1003178-1003200 | CCCACACCTTGGCCCAGCCCTGG | 620 | X40 |
| 16 | 2092489-2092511 | GCCGCACC-TGCCGCAGCCGTGG | 621 | RNA31 |
| 16 | 3089598-3089620 | CCCGCA-CTGGGTGCAGTGGTGG | 622 | RNA31 |
| 16 | 14882693-14882715 | CCCACACCCAGGTGCAGCGGCAG | 623 | X50 |
| 16 | 16097875-16097897 | CCAGCACC-TGGCACAGCAGGTG | 624 | RNA41 |
| 16 | 16281338-16281360 | CCCACACCCAGGTGCAGCGGCAG | 623 | X50 |
| 16 | 18430777-18430799 | CCCACACCCAGGTGCAGCGGCAG | 623 | X50 |
| 16 | 18513312-18513334 | CCCACACCCAGGTGCAGCGGCAG | 623 | X50 |
| 16 | 21358246-21358268 | CCCGCATCTTGGTGCAGCTGCTT | 625 | X50 |
| 16 | 28383449-28383471 | ACCGCACCATGGTGCAGCTGGGC | 626 | X50 |
| 16 | 28731839-28731861 | ACCGCACCATGGTGCAGCTGGGC | 626 | X50 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 16 | 29792483-29792505 | CCAACACC-TGGCGCAGAGTAGG | 627 | RNA41 |
| 16 | 29863301-29863323 | CTCGTACCAAAGCGCAGAGGAGG | 628 | X60 |
| 16 | 30783356-30783378 | CCCGCA-CTCGGTGCAGCGGTAT | 629 | RNA41 |
| 16 | 31081352-31081374 | CCCGCA-CTGGGTGCAGCGGAAG | 630 | RNA31 |
| 16 | 31436901-31436923 | GCCGCA-CTTGGCGCAGCTGTGG | 631 | RNA21 |
| 16 | 67748649-67748671 | CTAACACCTTGGTGCAGAGGTGG | 632 | X50 |
| 16 | 78768901-78768923 | CCTACACCATGGCGCAGCGTCAG | 633 | X50 |
| 16 | 81278358-81278380 | CCAGCACC-TGGCACATCGGTGG | 634 | RNA31 |
| 16 | 88044071-88044093 | CCCGCATCTTGGTGCAGCTGCTT | 625 | X50 |
| 16 | 88839686-88839708 | CCCGCA-CATGGTGCAGTGGCTG | 635 | RNA41 |
| 17 | 7223899-7223921 | CCCAC-CCCTGGCCCAGCCGAGG | 636 | RNA41 |
| 17 | 7462659-7462681 | TGCACACCTTGGCGCAGTGGGGG | 637 | X40 |
| 17 | 7511796-7511818 | CCAGCACC-TGGCACAGGGGAGG | 638 | RNA31 |
| 17 | 19391599-19391621 | CCCACACC-AGGCACAGAGGAGG | 639 | RNA41 |
| 17 | 26736056-26736078 | CCCGCACC-TGGCTCAGAGGGTC | 485 | RNA41 |
| 17 | 28662198-28662220 | GTAGCACGTTGACGCAGCAGCGG | 640 | X60 |
| 17 | 38870195-38870217 | GCCGCACC-GGGCGCAGTTGGGG | 641 | RNA41 |
| 17 | 45753295-45753317 | CCCACACC-TGCCCCAGAGGTGG | 642 | RNA41 |
| 17 | 45993823-45993845 | CCCACAGC-TGGCCCAGCAGGGG | 643 | RNA41 |
| 17 | 63929863-63929885 | TCAGCACCTTGGCACAGCTGAAG | 644 | X50 |
| 17 | 79154410-79154432 | ACAGCACCTCGGTGCAGCAGAGA | 645 | X60 |
| 17 | 81131740-81131762 | CCCTC-CCATGGCGCAGCTTCGG | 646 | RNA41 |
| 18 | 3448410-3448432 | CCCGCACC-GGGCGCAGCAGCTG | 647 | RNA31 |
| 18 | 39380982-39381004 | CATGCTACATGGCGCAGCGGTAG | 648 | X60 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 18 | 58247634-58247656 | CTCGCACCCGAACGCAGCAGAGG | 649 | X60 |
| 18 | 59917417-59917439 | TCCCCACCCCAGCGCAGCAGAGG | 650 | X60 |
| 18 | 78993257-78993279 | CGAAGACCTTGGCGCAGAAGCGG | 651 | X60 |
| 19 | 1104611-1104633 | CCCGCACCTTGGCCTAGCGCGGT | 652 | X40 |
| 19 | 1274125-1274147 | TCTGCACCTTGGCGCAGCTGGAG | 653 | X40 |
| 19 | 2209581-2209603 | CTCCCACCTTAAAGCAGCGGTGG | 654 | X50 |
| 19 | 5543277-5543299 | ACCGCACC-TGGCCCAGAGTGGG | 655 | RNA41 |
| 19 | 6431799-6431821 | CCCCCACCTTGGCCCAGCGTTGG | 656 | X30 |
| 19 | 10872441-10872463 | GCCACACC-TCGCACAGCGGTGG | 657 | RNA41 |
| 19 | 11391283-11391305 | ACCACACCTTGCTGCAGAGGAGG | 658 | X50 |
| 19 | 11406443-11406465 | CCCGCA-GAGGGCGCAGCGGCTG | 659 | RNA41 |
| 19 | 12747607-12747629 | CCAGCAC--TGGCTCAGCAGAGG | 660 | RNA32 |
| 19 | 36110180-36110202 | ACCGCACC-TGGCCCAAAGGGGG | 588 | RNA41 |
| 19 | 46709648-46709670 | ACCGCACC-CGGCCCAGTGGAGG | 661 | RNA41 |
| 19 | 49720095-49720117 | CCTGCACTCAGGCGCAGACGGGG | 662 | X60 |
| 19 | 50490618-50490640 | GCTGCACCTTGGCACAGTGGAGG | 663 | X40 |
| 19 | 51068476-51068498 | CCCACACCCAGGCCCAGAGGAGG | 664 | X50 |
| 19 | 51606728-51606750 | CCTGCACCT--GCACAGCAGGGG | 665 | RNA32 |
| 19 | 53775475-53775498 | CGAGCACCTTGGCAGCAGCTGAGG | 575 | DNA31 |
| 19 | 56088833-56088855 | CTCGCACC-TGGTGCAGCACCGG | 666 | RNA41 |
| 20 | 13900645-13900667 | GCCGCAC--AGGCACAGCGGCGG | 667 | RNA32 |
| 20 | 23109029-23109051 | TCAGCACCTTGGCACATCCAGGG | 668 | X60 |
| 20 | 31859435-31859457 | CCTGCACCTTTGCACAGCACTGG | 669 | X50 |
| 20 | 45967752-45967774 | CCCGCA-TGTGGCGCAGCAGTGT | 670 | RNA41 |

TABLE 10-continued

PCSK9 gRNA (Protospacer 5'-CCCGCACCTTGGCGCAGCGG-3' (SEQ ID NO: 13)) candidate off-target sites as determined by ONE-seq

| Chromosome | Location | Potential Off-target sequence (5'-3') | SEQ ID NO: | Alignment |
|---|---|---|---|---|
| 20 | 49558961-49558983 | CCCAGCACTTGGTGAAGCGGAGG | 671 | X60 |
| 21 | 37176555-37176577 | CCCACAC--TGGTGCAGAGGTGG | 672 | RNA32 |
| 22 | 22912001-22912023 | CCTGCACCATGGTGCACCGGCAG | 673 | X50 |
| 22 | 25849024-25849046 | CCCGCAC--AGCCGCAGAGGAGG | 674 | RNA32 |
| 22 | 27735501-27735523 | ACCGCACC-TGGCACAGCTTGGG | 675 | RNA41 |
| 22 | 49971621-49971643 | CCCACACCCTGGCCCAGCCTCGG | 676 | X50 |
| X | 1842130-1842152 | CCAGCACTTTGGTACAGCATAGG | 677 | X60 |
| X | 23566446-23566468 | CCCGCACC-TGGCTCAGAGGGGT | 571 | RNA31 |
| X | 50814798-50814820 | CCCGCACCCTGGCTCAGTGTTGG | 678 | X40 |
| X | 76172984-76173006 | CCCGCAC--AGGCGCAGAGGTGG | 679 | RNA22 |
| X | 83385071-83385093 | CCAGCACC-TGGTCCAGTGGAGG | 680 | RNA41 |
| X | 107536875-107536897 | CCAGCACC-TGGCACAGAGTAGG | 681 | RNA41 |

TABLE 11

PCSK9 gRNA GA346 off-target site validation in human primary hepatocytes

| Chromosome | Lot #: Location | STL Treated | HLY Treated | JLP Treated | STL Control | HLY Control | JLP Control | Average treated | Average untreated | Net Editing |
|---|---|---|---|---|---|---|---|---|---|---|
| 1 | 55040029-55040051 | 42.18 | 49.76 | 78.54 | 0.13 | 0.19 | 0.03 | 56.83 | 0.12 | 56.71 |
| 1 | 54256943-54256966 | 0 | 0.07 | 0.04 | 0.1 | 0 | 0.03 | 0.04 | 0.04 | -0.01 |
| 1 | 22256342-22256365 | 0 | 0 | 0.02 | 0 | 0.07 | 0.02 | 0.01 | 0.03 | -0.02 |
| 1 | 10640222-10640244 | 0 | 0 | 0 | 0 | 0.04 | 0 | 0.00 | 0.01 | -0.01 |
| 1 | 6888039-6888061 | 0 | 0 | 0.03 | 0.03 | 0.05 | 0.03 | 0.01 | 0.04 | -0.03 |
| 1 | 60335313-60335335 | 0 | 0.02 | 0.01 | 0.03 | 0 | 0.02 | 0.01 | 0.02 | -0.01 |
| 1 | 64198527-64198549 | 0 | 0.07 | 0 | 0.02 | 0.06 | 0 | 0.02 | 0.03 | 0.00 |
| 1 | 64266524-64266546 | 0 | 0.04 | 0.05 | 0.02 | 0 | 0.05 | 0.03 | 0.02 | 0.01 |
| 1 | 121262583-121262605 | 0.02 | 0.04 | 0.05 | 0.02 | 0 | 0.04 | 0.04 | 0.02 | 0.02 |
| 1 | 20712184-20712206 | 0.05 | 0.05 | 0.03 | 0.03 | 0.06 | 0.06 | 0.04 | 0.05 | -0.01 |
| 1 | 240808285-240808307 | 0.06 | 0.03 | 0.01 | 0 | 0.06 | 0.02 | 0.03 | 0.03 | 0.01 |
| 1 | 145017699-145017721 | 0.05 | 0.05 | 0.08 | 0.07 | 0.14 | 0.05 | 0.06 | 0.09 | -0.03 |
| 1 | 155615561-155615583 | 0 | 0.04 | 0.01 | 0 | 0.05 | 0.03 | 0.02 | 0.03 | -0.01 |

TABLE 11-continued

PCSK9 gRNA GA346 off-target site validation in human primary hepatocytes

| Chromosome | Lot #: Location | STL Treated | HLY Treated | JLP Treated | STL Control | HLY Control | JLP Control | Average treated | Average untreated | Net Editing |
|---|---|---|---|---|---|---|---|---|---|---|
| 1 | 155751756-155751778 | 0.02 | 0 | 0.06 | 0.01 | 0.09 | 0.07 | 0.03 | 0.06 | −0.03 |
| 1 | 206281058-206281080 | 0 | 0.08 | 0.08 | 0.02 | 0.07 | 0 | 0.05 | 0.03 | 0.02 |
| 1 | 208574946-208574968 | 0 | 0 | 0 | 0 | 0 | 0.05 | 0.00 | 0.02 | −0.02 |
| 1 | 15101074-15101096 | 0 | 0 | 0.05 | 0.02 | 0.06 | 0 | 0.02 | 0.03 | −0.01 |
| 1 | 25103342-25103364 | 0.06 | 0 | 0.03 | 0.03 | 0.03 | 0 | 0.03 | 0.02 | 0.01 |
| 1 | 29882027-29882049 | 0.03 | 0 | 0.04 | 0.05 | 0 | 0 | 0.02 | 0.02 | 0.01 |
| 1 | 40866872-40866894 | 0 | 0 | 0.05 | 0.02 | 0 | 0 | 0.02 | 0.01 | 0.01 |
| 1 | 43692630-43692652 | 0 | 0 | 0 | 0.02 | 0.04 | 0.01 | 0.00 | 0.02 | −0.02 |
| 1 | 44163492-44163514 | 0 | 0 | 0 | 0 | 0 | 0.03 | 0.00 | 0.01 | −0.01 |
| 1 | 110096163-110096185 | 0 | 0 | 0.02 | 0.03 | 0 | 0.03 | 0.01 | 0.02 | −0.01 |
| 1 | 157194781-157194803 | 0 | 0 | 0.03 | 0 | 0 | 0 | 0.01 | 0.00 | 0.01 |
| 1 | 163263975-163263997 | 0 | 0 | 0 | 0 | 0 | 0 | 0.00 | 0.00 | 0.00 |
| 1 | 175575740-175575762 | 0 | 0.05 | 0.06 | 0.07 | 0 | 0 | 0.04 | 0.02 | 0.01 |
| 1 | 204314754-204314776 | 0 | 0.08 | 0.04 | 0.04 | 0.02 | 0.06 | 0.04 | 0.04 | 0.00 |
| 1 | 228337504-228337526 | 0.02 | 0 | 0.01 | 0.05 | 0.05 | 0.01 | 0.01 | 0.04 | −0.03 |
| 2 | 107914896-107914919 | 0.04 | 0 | 0 | 0.11 | 0 | 0 | 0.01 | 0.04 | −0.02 |
| 2 | 110633933-110633956 | 0 | 0 | 0.02 | 0.03 | 0 | 0.06 | 0.01 | 0.03 | −0.02 |
| 2 | 69112187-69112209 | 0 | 0 | 0 | 0 | 0.07 | 0 | 0.00 | 0.02 | −0.02 |
| 2 | 72985325-72985347 | 0.03 | 0 | 0 | 0.01 | 0 | 0.05 | 0.01 | 0.02 | −0.01 |
| 2 | 90356123-90356145 | 0.05 | 0 | 0 | 0.01 | 0 | 0 | 0.02 | 0.00 | 0.01 |
| 2 | 127571237-127571259 | 0.03 | 0.04 | 0.01 | 0 | 0.04 | 0.02 | 0.03 | 0.02 | 0.01 |
| 2 | 197360047-197360069 | 0 | 0.04 | 0 | 0 | 0 | 0.05 | 0.01 | 0.02 | 0.00 |
| 2 | 231686140-231686162 | 0.05 | 0.12 | 0 | 0.02 | 0 | 0 | 0.06 | 0.01 | 0.05 |
| 2 | 9138986-9139008 | 96.7 | 99.46 | 96.44 | 97.34 | 99.52 | 96.8 | 97.53 | 97.89 | −0.35 |
| 2 | 11670027-11670049 | 0.03 | 0 | 0.02 | 0 | 0 | 0.11 | 0.02 | 0.04 | −0.02 |
| 2 | 15561025-15561047 | 0 | 0 | 0 | 0.06 | 0.06 | 0.06 | 0.00 | 0.06 | −0.06 |
| 2 | 42969964-42969986 | 0.03 | 0 | 0.04 | 0.05 | 0.08 | 0.03 | 0.02 | 0.05 | −0.03 |
| 2 | 71667395-71667417 | 0 | 0.04 | 0.02 | 0.05 | 0.08 | 0 | 0.02 | 0.04 | −0.02 |
| 2 | 85317392-85317414 | 0.02 | 0.06 | 0 | 0.01 | 0 | 0.03 | 0.03 | 0.01 | 0.01 |
| 2 | 120922089-120922111 | 0.03 | 0.03 | 0.03 | 0.01 | 0 | 0.05 | 0.03 | 0.02 | 0.01 |
| 2 | 132524147-132524169 | 0 | 0.05 | 0 | 0.06 | 0.08 | 0.08 | 0.02 | 0.07 | −0.06 |
| 2 | 179801496-179801518 | 0.03 | 0.04 | 0 | 0.01 | 0 | 0.01 | 0.02 | 0.01 | 0.02 |
| 2 | 182608809-182608831 | 0 | 0 | 0.09 | 0.14 | 0 | 0 | 0.03 | 0.05 | −0.02 |
| 2 | 203866756-203866778 | 0.02 | 0.11 | 0.04 | 0 | 0.04 | 0.01 | 0.06 | 0.02 | 0.04 |
| 2 | 219451287-219451309 | 0 | 0 | 0.02 | 0 | 0.08 | 0.02 | 0.01 | 0.03 | −0.03 |
| 3 | 14242673-14242696 | 0.03 | 0 | 0 | 0.04 | 0 | 0.01 | 0.01 | 0.02 | −0.01 |
| 3 | 10287991-10288013 | 0 | 0 | 0 | 0 | 0 | 0.06 | 0.00 | 0.02 | −0.02 |

TABLE 11-continued

PCSK9 gRNA GA346 off-target site validation in human primary hepatocytes

| Chromosome | Lot #: Location | STL Treated | HLY Treated | JLP Treated | STL Control | HLY Control | JLP Control | Average treated | Average untreated | Net Editing |
|---|---|---|---|---|---|---|---|---|---|---|
| 3 | 13178217-13178239 | 0.03 | 0 | 0.02 | 0.03 | 0.03 | 0.01 | 0.02 | 0.02 | −0.01 |
| 3 | 118171480-118171502 | 0 | 0 | 0 | 0.05 | 0 | 0 | 0.00 | 0.02 | −0.02 |
| 3 | 14819436-14819458 | 0.02 | 0 | 0 | 0.01 | 0 | 0.03 | 0.01 | 0.01 | −0.01 |
| 3 | 54016522-54016544 | 0.06 | 0 | 0 | 0.01 | 0.05 | 0 | 0.02 | 0.02 | 0.00 |
| 3 | 139677330-139677352 | 0 | 0 | 0 | 0.06 | 0 | 0.03 | 0.00 | 0.03 | −0.03 |
| 3 | 38369509-38369531 | 0.03 | 0 | 0 | 0 | 0 | 0 | 0.01 | 0.00 | 0.01 |
| 3 | 52005791-52005813 | 0.03 | 0 | 0.04 | 0 | 0 | 0.02 | 0.02 | 0.01 | 0.02 |
| 3 | 118171416-118171438 | 0.15 | 0.06 | 0 | 0 | 0 | 0.03 | 0.07 | 0.01 | 0.06 |
| 3 | 139288546-139288568 | 0 | 0.02 | 0.04 | 0.03 | 0 | 0 | 0.02 | 0.01 | 0.01 |
| 3 | 139731008-139731030 | 0 | 0.02 | 0.07 | 0.03 | 0 | 0 | 0.03 | 0.01 | 0.02 |
| 3 | 150408362-150408384 | 0 | 0 | 0.04 | 0 | 0 | 0.04 | 0.01 | 0.01 | 0.00 |
| 3 | 182806878-182806900 | 0.09 | 0 | 0.04 | 0 | 0 | 0.05 | 0.04 | 0.02 | 0.03 |
| 4 | 139511785-139511808 | 0 | 0 | 0 | 0.03 | 0 | 0.03 | 0.00 | 0.02 | −0.02 |
| 4 | 84244376-84244398 | 0.03 | 0 | 0.05 | 0.06 | 0 | 0.01 | 0.03 | 0.02 | 0.00 |
| 4 | 114598629-114598651 | 0 | 0 | 0.02 | 0 | 0 | 0 | 0.01 | 0.00 | 0.01 |
| 4 | 6008382-6008404 | 0 | 0 | 0.04 | 0 | 0 | 0.12 | 0.01 | 0.04 | −0.03 |
| 4 | 7054192-7054214 | 0.14 | 0.02 | 0 | 0.02 | 0.07 | 0.01 | 0.05 | 0.03 | 0.02 |
| 4 | 158623208-158623230 | 0 | 0 | 0.12 | 0 | 0 | 0 | 0.04 | 0.00 | 0.04 |
| 4 | 1221653-1221675 | 0.05 | 0 | 0.01 | 0.03 | 0 | 0.05 | 0.02 | 0.03 | −0.01 |
| 4 | 1308120-1308142 | 0.03 | 0 | 0.02 | 0 | 0 | 0 | 0.02 | 0.00 | 0.02 |
| 4 | 6747615-6747637 | 0.03 | 0 | 0.05 | 0.02 | 0 | 0.04 | 0.03 | 0.02 | 0.01 |
| 4 | 37229056-37229078 | 0.03 | 0.02 | 0 | 0.05 | 0 | 0.05 | 0.02 | 0.03 | −0.02 |
| 4 | 115179695-115179717 | 0 | 0 | 0 | 0 | 0 | 0 | 0.00 | 0.00 | 0.00 |
| 4 | 141615591-141615613 | 0 | 0 | 0.05 | 0 | 0 | 0 | 0.02 | 0.00 | 0.02 |
| 4 | 182110224-182110246 | 0.04 | 0 | 0.05 | 0.05 | 0.06 | 0.02 | 0.03 | 0.04 | −0.01 |
| 5 | 126628420-126628443 | 0.03 | 0.07 | 0 | 0.05 | 0 | 0 | 0.03 | 0.02 | 0.02 |
| 5 | 77203454-77203476 | 0.06 | 0 | 0.07 | 0.1 | 0 | 0.05 | 0.04 | 0.05 | −0.01 |
| 5 | 126364896-126364918 | 0.03 | 0 | 0 | 0 | 0 | 0 | 0.01 | 0.00 | 0.01 |
| 5 | 767330-767352 | 0.09 | 0.04 | 0.05 | 0.03 | 0.06 | 0.04 | 0.06 | 0.04 | 0.02 |
| 5 | 1516550-1516572 | 0 | 0.06 | 0 | 0 | 0 | 0.03 | 0.02 | 0.01 | 0.01 |
| 5 | 173667321-173667343 | 0.02 | 0 | 0.01 | 0.03 | 0.04 | 0.02 | 0.01 | 0.03 | −0.02 |
| 5 | 178526685-178526707 | 0 | 0 | 0 | 0 | 0.03 | 0.03 | 0.00 | 0.02 | −0.02 |
| 6 | 44047493-44047515 | 0.06 | 0.02 | 0.04 | 0.09 | 0 | 0.05 | 0.04 | 0.05 | −0.01 |
| 6 | 73315113-73315135 | 0 | 0 | 0 | 0.07 | 0.04 | 0 | 0.00 | 0.04 | −0.04 |
| 6 | 148698322-148698344 | 0 | 0 | 0.13 | 0.07 | 0 | 0.11 | 0.04 | 0.06 | −0.02 |
| 6 | 153756217-153756239 | 0 | 0 | 0.01 | 0.07 | 0.11 | 0 | 0.00 | 0.06 | −0.06 |
| 6 | 138138382-138138404 | 0.06 | 0 | 0 | 0.04 | 0 | 0.03 | 0.02 | 0.02 | 0.00 |

TABLE 11-continued

PCSK9 gRNA GA346 off-target site validation in human primary hepatocytes

| Chromosome | Lot #: Location | STL Treated | HLY Treated | JLP Treated | STL Control | HLY Control | JLP Control | Average treated | Average untreated | Net Editing |
|---|---|---|---|---|---|---|---|---|---|---|
| 6 | 165843913-165843935 | 0.03 | 0.07 | 0 | 0.05 | 0 | 0.03 | 0.03 | 0.03 | 0.01 |
| 6 | 3751269-3751291 | 0 | 0 | 0 | 0 | 0 | 0 | 0.00 | 0.00 | 0.00 |
| 6 | 15092621-15092643 | 0 | 0.03 | 0.02 | 0.01 | 0 | 0 | 0.02 | 0.00 | 0.01 |
| 6 | 16346963-16346985 | 0.07 | 0 | 0 | 0 | 0 | 0 | 0.02 | 0.00 | 0.02 |
| 6 | 29016770-29016792 | 0 | 0 | 0 | 0.02 | 0.08 | 0.02 | 0.00 | 0.04 | −0.04 |
| 6 | 36310604-36310626 | 0.06 | 0 | 0.06 | 0.01 | 0.1 | 0.09 | 0.04 | 0.07 | −0.03 |
| 6 | 47477658-47477680 | 0.2 | 0 | 0 | 0.07 | 0 | 0.03 | 0.07 | 0.03 | 0.03 |
| 6 | 139537177-139537199 | 0 | 0 | 0 | 0.03 | 0 | 0 | 0.00 | 0.01 | −0.01 |
| 7 | 24849083-24849106 | 0 | 0.05 | 0.06 | 0.03 | 0 | 0 | 0.04 | 0.01 | 0.03 |
| 7 | 129225099-129225122 | 0 | 0 | 0 | 0 | 0 | 0 | 0.00 | 0.00 | 0.00 |
| 7 | 93102-93124 | 0.37 | 0 | 0.28 | 0.04 | 0 | 0.05 | 0.22 | 0.03 | 0.19 |
| 7 | 5360719-5360741 | 0 | 0.03 | 0.07 | 0.02 | 0 | 0.1 | 0.03 | 0.04 | −0.01 |
| 7 | 74043103-74043125 | 0.1 | 0 | 0.07 | 0.04 | 0 | 0.04 | 0.06 | 0.03 | 0.03 |
| 7 | 96041009-96041031 | 0.17 | 0.09 | 0.03 | 0.03 | 0.11 | 0.11 | 0.10 | 0.08 | 0.01 |
| 7 | 98765214-98765236 | 0 | 0 | 0 | 0 | 0.05 | 0.03 | 0.00 | 0.03 | −0.03 |
| 7 | 106882973-106882995 | 0 | 0.12 | 0.02 | 0.09 | 0.05 | 0.02 | 0.05 | 0.05 | −0.01 |
| 7 | 123763164-123763186 | 0.08 | 0.29 | 0 | 0 | 0 | 0.13 | 0.12 | 0.04 | 0.08 |
| 7 | 147737806-147737828 | 0 | 44.29 | 0.19 | 0.11 | 43.85 | 0 | 14.83 | 14.65 | 0.17 |
| 7 | 153256176-153256198 | 0 | 0.05 | 0.04 | 0 | 0 | 0.03 | 0.03 | 0.01 | 0.02 |
| 7 | 155527865-155527887 | 0 | 0 | 0 | 0 | 0 | 0 | 0.00 | 0.00 | 0.00 |
| 7 | 139596895-139596917 | 0 | 0.03 | 0.03 | 0.03 | 0.03 | 0 | 0.02 | 0.02 | 0.00 |
| 7 | 150737589-150737611 | 0.05 | 0.13 | 0.05 | 0.01 | 0.05 | 0.18 | 0.08 | 0.08 | 0.00 |
| 8 | 139813559-139813582 | 0 | 0.06 | 0 | 0 | 0.06 | 0 | 0.02 | 0.02 | 0.00 |
| 8 | 2485153-2485175 | 0.05 | 0 | 0.03 | 0.03 | 0 | 0.06 | 0.03 | 0.03 | 0.00 |
| 8 | 100957388-100957410 | 0 | 0 | 0 | 0.03 | 0 | 0 | 0.00 | 0.01 | −0.01 |
| 8 | 143383198-143383220 | 0.02 | 0.11 | 0.04 | 0.11 | 0.09 | 0 | 0.06 | 0.07 | −0.01 |
| 8 | 26191893-26191915 | 0 | 0.06 | 0 | 0.02 | 0.13 | 0.02 | 0.02 | 0.06 | −0.04 |
| 8 | 142499068-142499090 | 0.03 | 0 | 0 | 0 | 0.08 | 0 | 0.01 | 0.03 | −0.02 |
| 9 | 137012994-137013016 | 0.05 | 0 | 0.07 | 0.02 | 0 | 0.03 | 0.04 | 0.02 | 0.02 |
| 9 | 137167999-137168021 | 0.03 | 0 | 0 | 0 | 0 | 0.03 | 0.01 | 0.01 | 0.00 |
| 9 | 109123571-109123593 | 0.03 | 0 | 0 | 0.02 | 0 | 0 | 0.01 | 0.01 | 0.00 |
| 9 | 137477162-137477184 | 0.05 | 0.06 | 0.02 | 0.02 | 0.03 | 0.05 | 0.04 | 0.03 | 0.01 |
| 9 | 33873295-33873317 | 0.05 | 0 | 0 | 0 | 0 | 0 | 0.02 | 0.00 | 0.02 |
| 9 | 34958979-34959001 | 0.1 | 0.03 | 0 | 0.01 | 0 | 0.01 | 0.04 | 0.01 | 0.04 |
| 10 | 28839554-28839576 | 0 | 0.18 | 0.08 | 0.11 | 0 | 0 | 0.09 | 0.04 | 0.05 |
| 10 | 59089166-59089189 | 0 | 0 | 0 | 0 | 0.06 | 0 | 0.00 | 0.02 | −0.02 |
| 10 | 97031490-97031512 | 0.1 | 0.12 | 0 | 0.01 | 0.03 | 0.09 | 0.07 | 0.04 | 0.03 |

TABLE 11-continued

PCSK9 gRNA GA346 off-target site validation in human primary hepatocytes

| Chromosome | Lot #: Location | STL Treated | HLY Treated | JLP Treated | STL Control | HLY Control | JLP Control | Average treated | Average untreated | Net Editing |
|---|---|---|---|---|---|---|---|---|---|---|
| 10 | 122572126-122572148 | 0 | 0.05 | 0.03 | 0 | 0 | 0 | 0.03 | 0.00 | 0.03 |
| 10 | 130560773-130560795 | 0.03 | 0.02 | 0.03 | 0.02 | 0 | 0 | 0.03 | 0.01 | 0.02 |
| 10 | 5824416-5824438 | 0 | 0.09 | 0.01 | 0 | 0 | 0 | 0.03 | 0.00 | 0.03 |
| 10 | 16285410-16285432 | 0.08 | 0.09 | 0 | 0.05 | 0 | 0.03 | 0.06 | 0.03 | 0.03 |
| 10 | 20297215-20297237 | 0 | 0 | 0 | 0 | 0 | 0 | 0.00 | 0.00 | 0.00 |
| 10 | 21126683-21126705 | 0.08 | 0.09 | 0 | 0.05 | 0 | 0 | 0.06 | 0.02 | 0.04 |
| 10 | 47223533-47223555 | 0 | 0 | 0.02 | 0.03 | 0 | 0.03 | 0.01 | 0.02 | -0.01 |
| 10 | 60958888-60958910 | 0.1 | 0 | 0.12 | 0 | 0.14 | 0.03 | 0.07 | 0.06 | 0.02 |
| 10 | 88036335-88036357 | 0.03 | 0 | 0.02 | 0.02 | 0 | 0.02 | 0.02 | 0.01 | 0.00 |
| 10 | 111259337-111259359 | 0.08 | 0 | 0 | 0.09 | 0 | 0 | 0.03 | 0.03 | 0.00 |
| 10 | 1572578-1572600 | 0.03 | 0 | 0.03 | 0 | 0.05 | 0.05 | 0.02 | 0.03 | -0.01 |
| 11 | 47941203-47941225 | 0 | 0.05 | 0.02 | 0 | 0 | 0.03 | 0.02 | 0.01 | 0.01 |
| 11 | 57761981-57762003 | 0 | 0 | 0.02 | 0.01 | 0 | 0.08 | 0.01 | 0.03 | -0.02 |
| 11 | 76659109-76659131 | 0 | 0 | 0 | 0 | 0 | 0.01 | 0.00 | 0.00 | 0.00 |
| 11 | 117692097-117692119 | 0 | 0.04 | 0 | 0.01 | 0 | 0.02 | 0.01 | 0.01 | 0.00 |
| 11 | 10630862-10630884 | 0.03 | 0 | 0 | 0.02 | 0 | 0.06 | 0.01 | 0.03 | -0.02 |
| 11 | 18729719-18729741 | 0 | 0 | 0.06 | 0.06 | 0.1 | 0.08 | 0.02 | 0.08 | -0.06 |
| 11 | 47350413-47350435 | 0.05 | 0 | 0 | 0.06 | 0.07 | 0 | 0.02 | 0.04 | -0.03 |
| 11 | 72870610-72870632 | 0 | 0 | 0 | 0 | 0 | 0.24 | 0.00 | 0.08 | -0.08 |
| 11 | 2916587-2916609 | 0 | 0 | 0.01 | 0 | 0 | 0 | 0.00 | 0.00 | 0.00 |
| 11 | 121325368-121325390 | 0 | 0.04 | 0.09 | 0.07 | 0.06 | 0.05 | 0.04 | 0.06 | -0.02 |
| 11 | 129981605-129981627 | 0 | 0 | 0.04 | 0.06 | 0.13 | 0.04 | 0.01 | 0.08 | -0.06 |
| 12 | 3851459-3851481 | 0 | 0 | 0 | 0 | 0 | 0 | 0.00 | 0.00 | 0.00 |
| 12 | 32850805-32850827 | 0.06 | 0 | 0.07 | 0.05 | 0.07 | 0 | 0.04 | 0.04 | 0.00 |
| 12 | 65971780-65971802 | 0.06 | 0.04 | 0.03 | 0 | 0 | 0 | 0.04 | 0.00 | 0.04 |
| 12 | 95590363-95590385 | 0 | 0.18 | 0 | 0.08 | 0 | 0.08 | 0.06 | 0.05 | 0.01 |
| 12 | 127431260-127431282 | 0.05 | 0.04 | 0.11 | 0.06 | 0.12 | 0.04 | 0.07 | 0.07 | -0.01 |
| 12 | 48000120-48000142 | 0 | 0 | 0.02 | 0 | 0.06 | 0.02 | 0.01 | 0.03 | -0.02 |
| 12 | 53328526-53328548 | 0 | 0 | 0 | 0.06 | 0.09 | 0.02 | 0.00 | 0.06 | -0.06 |
| 12 | 54190321-54190343 | 0.06 | 0.02 | 0.03 | 0.01 | 0 | 0.05 | 0.04 | 0.02 | 0.02 |
| 12 | 106690762-106690784 | 0 | 0 | 0 | 0.01 | 0 | 0.01 | 0.00 | 0.01 | -0.01 |
| 12 | 114491014-114491036 | 0.11 | 0 | 0 | 0.05 | 0.1 | 0.05 | 0.04 | 0.07 | -0.03 |
| 13 | 69424400-69424422 | 0 | 0.04 | 0.03 | 0.01 | 0.13 | 0 | 0.02 | 0.05 | -0.02 |
| 13 | 25788073-25788095 | 0.05 | 0.04 | 0.04 | 0.03 | 0.05 | 0 | 0.04 | 0.03 | 0.02 |
| 13 | 98388403-98388425 | 0 | 0.06 | 0.02 | 0 | 0 | 0 | 0.03 | 0.00 | 0.03 |
| 14 | 20813343-20813366 | 0.05 | 0.02 | 0.01 | 0.02 | 0 | 0.05 | 0.03 | 0.02 | 0.00 |
| 14 | 24408232-24408254 | 0 | 0.03 | 0.07 | 0.06 | 0 | 0.07 | 0.03 | 0.04 | -0.01 |

TABLE 11-continued

PCSK9 gRNA GA346 off-target site validation in human primary hepatocytes

| Chromosome | Lot #: Location | STL Treated | HLY Treated | JLP Treated | STL Control | HLY Control | JLP Control | Average treated | Average untreated | Net Editing |
|---|---|---|---|---|---|---|---|---|---|---|
| 14 | 38663021-38663043 | 0.08 | 0 | 0.01 | 0.06 | 0 | 0 | 0.03 | 0.02 | 0.01 |
| 14 | 100213915-100213937 | 0 | 0 | 0 | 0.03 | 0 | 0 | 0.00 | 0.01 | −0.01 |
| 14 | 90554536-90554558 | 0 | 0 | 0.01 | 0.06 | 0 | 0.03 | 0.00 | 0.03 | −0.03 |
| 14 | 102929418-102929440 | 0 | 0 | 0.03 | 0.03 | 0 | 0 | 0.01 | 0.01 | 0.00 |
| 14 | 65250553-65250575 | 0.04 | 0 | 0 | 0.04 | 0 | 0 | 0.01 | 0.01 | 0.00 |
| 14 | 89310097-89310119 | 0.06 | 0 | 0.06 | 0.03 | 0.06 | 0.04 | 0.04 | 0.04 | 0.00 |
| 14 | 101153383-101153405 | 0 | 0.04 | 0 | 0 | 0 | 0 | 0.01 | 0.00 | 0.01 |
| 15 | 69452825-69452848 | 0 | 0 | 0.03 | 0.04 | 0 | 0.03 | 0.01 | 0.02 | −0.01 |
| 15 | 42252041-42252063 | 0 | 0 | 0 | 0 | 0 | 0 | 0.00 | 0.00 | 0.00 |
| 15 | 99993270-99993292 | 0.03 | 0 | 0.02 | 0 | 0 | 0 | 0.02 | 0.00 | 0.02 |
| 15 | 47827093-47827115 | 0.08 | 0.04 | 0.02 | 0.04 | 0 | 0 | 0.05 | 0.01 | 0.03 |
| 15 | 86059010-86059032 | 0.05 | 0.02 | 0.07 | 0.05 | 0.05 | 0.01 | 0.05 | 0.04 | 0.01 |
| 15 | 94089230-94089252 | 0.11 | 0.04 | 0.04 | 0.07 | 0.02 | 0.02 | 0.06 | 0.04 | 0.03 |
| 16 | 3089598-3089620 | 0 | 0.03 | 0.01 | 0 | 0.07 | 0 | 0.01 | 0.02 | −0.01 |
| 16 | 30783356-30783378 | 0 | 0 | 0 | 0.04 | 0 | 0.02 | 0.00 | 0.02 | −0.02 |
| 16 | 31081352-31081374 | 0.03 | 0 | 0.04 | 0 | 0 | 0 | 0.02 | 0.00 | 0.02 |
| 16 | 31436901-31436923 | 0.02 | 0.02 | 0.01 | 0.01 | 0.05 | 0.03 | 0.02 | 0.03 | −0.01 |
| 16 | 2092489-2092511 | 0.05 | 0 | 0 | 0 | 0.03 | 0 | 0.02 | 0.01 | 0.01 |
| 16 | 16097875-16097897 | 0.03 | 0.04 | 0.02 | 0.04 | 0.04 | 0.14 | 0.03 | 0.07 | −0.04 |
| 16 | 29792483-29792505 | 0.06 | 0.03 | 0.11 | 0.11 | 0 | 0.03 | 0.07 | 0.05 | 0.02 |
| 16 | 88839686-88839708 | 0.03 | 0 | 0 | 0 | 0 | 0.04 | 0.01 | 0.01 | 0.00 |
| 16 | 81278358-81278380 | 0 | 0 | 0 | 0 | 0 | 0.04 | 0.00 | 0.01 | −0.01 |
| 16 | 1003178-1003200 | 0.09 | 0 | 0.04 | 0.02 | 0 | 0 | 0.04 | 0.01 | 0.04 |
| 16 | 14882693-14882715 | 0.06 | 0.03 | 0.07 | 0.09 | 0 | 0.01 | 0.05 | 0.03 | 0.02 |
| 16 | 16281338-16281360 | 0.02 | 0.04 | 0.06 | 0.06 | 0 | 0.06 | 0.04 | 0.04 | 0.00 |
| 16 | 18430777-18430799 | 0.08 | 0 | 0.09 | 0.07 | 0.05 | 0.02 | 0.06 | 0.05 | 0.01 |
| 16 | 18513312-18513334 | 0.04 | 0 | 0 | 0.02 | 0 | 0.07 | 0.01 | 0.03 | −0.02 |
| 16 | 21358246-21358268 | 0 | 0 | 0 | 0.02 | 0 | 0.02 | 0.00 | 0.01 | −0.01 |
| 16 | 28383449-28383471 | 0.02 | 0.1 | 0.03 | 0.03 | 0.04 | 0.01 | 0.05 | 0.03 | 0.02 |
| 16 | 28731839-28731861 | 0.05 | 0.02 | 0.05 | 0.02 | 0 | 0.04 | 0.04 | 0.02 | 0.02 |
| 16 | 29863301-29863323 | 0 | 0 | 0 | 0.03 | 0 | 0 | 0.00 | 0.01 | −0.01 |
| 16 | 67748649-67748671 | 0 | 0 | 0.03 | 0 | 0 | 0 | 0.01 | 0.00 | 0.01 |
| 16 | 78768901-78768923 | 0.04 | 0 | 0.01 | 0 | 0.02 | 0.03 | 0.02 | 0.02 | 0.00 |
| 16 | 88044071-88044093 | 0 | 0 | 0 | 0 | 0 | 0 | 0.00 | 0.00 | 0.00 |
| 17 | 7223899-7223921 | 0 | 0 | 0 | 0.02 | 0 | 0.06 | 0.00 | 0.03 | −0.03 |
| 17 | 7511796-7511818 | 0 | 0.02 | 0.05 | 0.04 | 0.09 | 0 | 0.02 | 0.04 | −0.02 |
| 17 | 19391599-19391621 | 0.03 | 0.03 | 0.1 | 0.05 | 0.06 | 0.06 | 0.05 | 0.06 | 0.00 |

TABLE 11-continued

PCSK9 gRNA GA346 off-target site validation in human primary hepatocytes

| Chromosome | Lot #: Location | STL Treated | HLY Treated | JLP Treated | STL Control | HLY Control | JLP Control | Average treated | Average untreated | Net Editing |
|---|---|---|---|---|---|---|---|---|---|---|
| 17 | 26736056-26736078 | 0.03 | 0.08 | 0 | 0.04 | 0 | 0 | 0.04 | 0.01 | 0.02 |
| 17 | 38870195-38870217 | 0 | 0.03 | 0.05 | 0.03 | 0.07 | 0 | 0.03 | 0.03 | −0.01 |
| 17 | 45753295-45753317 | 0.03 | 0 | 0.02 | 0.04 | 0 | 0.04 | 0.02 | 0.03 | −0.01 |
| 17 | 45993823-45993845 | 0 | 0.06 | 0.02 | 0.05 | 0.07 | 0 | 0.03 | 0.04 | −0.01 |
| 17 | 81131740-81131762 | 0 | 0 | 0 | 0.01 | 0 | 0.03 | 0.00 | 0.01 | −0.01 |
| 17 | 7462659-7462681 | 0.05 | 0 | 0.04 | 0.01 | 0.06 | 0 | 0.03 | 0.02 | 0.01 |
| 17 | 28662198-28662220 | 0 | 0 | 0 | 0.07 | 0 | 0.03 | 0.00 | 0.03 | −0.03 |
| 17 | 63929863-63929885 | 0.07 | 0.02 | 0.03 | 0.01 | 0.02 | 0.03 | 0.04 | 0.02 | 0.02 |
| 17 | 79154410-79154432 | 0 | 0 | 0.03 | 0.02 | 0 | 0 | 0.01 | 0.01 | 0.00 |
| 18 | 3448410-3448432 | 0.03 | 0 | 0 | 0 | 0 | 0 | 0.01 | 0.00 | 0.01 |
| 18 | 39380982-39381004 | 0 | 0.04 | 0.03 | 0.01 | 0 | 0.05 | 0.02 | 0.02 | 0.00 |
| 18 | 58247634-58247656 | 0.08 | 0.02 | 0 | 0 | 0.05 | 0.03 | 0.03 | 0.03 | 0.01 |
| 18 | 59917417-59917439 | 0.06 | 0 | 0 | 0.02 | 0 | 0 | 0.02 | 0.01 | 0.01 |
| 18 | 78993257-78993279 | 0 | 0 | 0.04 | 0 | 0.11 | 0.02 | 0.01 | 0.04 | −0.03 |
| 19 | 53775475-53775498 | 0.03 | 0 | 0.02 | 0.02 | 0 | 0 | 0.02 | 0.01 | 0.01 |
| 19 | 11406443-11406465 | 0.02 | 0 | 0.08 | 0.02 | 0 | 0.1 | 0.03 | 0.04 | −0.01 |
| 19 | 10872441-10872463 | 0.06 | 0 | 0 | 0.03 | 0 | 0.03 | 0.02 | 0.02 | 0.00 |
| 19 | 36110180-36110202 | 0 | 0 | 0 | 0.13 | 0 | 0 | 0.00 | 0.04 | −0.04 |
| 19 | 46709648-46709670 | 0 | 0 | 0.09 | 0.03 | 0 | 0.12 | 0.03 | 0.05 | −0.02 |
| 19 | 12747607-12747629 | 0.03 | 0 | 0.06 | 0.04 | 0.05 | 0.02 | 0.03 | 0.04 | −0.01 |
| 19 | 56088833-56088855 | 0 | 0.07 | 0 | 0.05 | 0.14 | 0 | 0.02 | 0.06 | −0.04 |
| 19 | 51606728-51606750 | 0.02 | 0 | 0.01 | 0.01 | 0 | 0.06 | 0.01 | 0.02 | −0.01 |
| 19 | 1104611-1104633 | 0 | 0 | 0 | 0 | 0 | 0 | 0.00 | 0.00 | 0.00 |
| 19 | 1274125-1274147 | 0 | 0.05 | 0.02 | 0.05 | 0 | 0 | 0.02 | 0.02 | 0.01 |
| 19 | 2209581-2209603 | 0 | 0 | 0 | 0.02 | 0.07 | 0 | 0.00 | 0.03 | −0.03 |
| 19 | 6431799-6431821 | 0 | 0 | 0 | 0 | 0 | 0.03 | 0.00 | 0.01 | −0.01 |
| 19 | 11391283-11391305 | 0.03 | 0.04 | 0.03 | 0.07 | 0.1 | 0.03 | 0.03 | 0.07 | −0.03 |
| 19 | 49720095-49720117 | 0.04 | 0 | 0 | 0 | 0 | 0.1 | 0.01 | 0.03 | −0.02 |
| 19 | 50490618-50490640 | 0 | 0.05 | 0.02 | 0 | 0.03 | 0 | 0.02 | 0.01 | 0.01 |
| 19 | 51068476-51068498 | 0.07 | 0.06 | 0.1 | 0.08 | 0 | 0.02 | 0.08 | 0.03 | 0.04 |
| 20 | 45967752-45967774 | 0 | 0 | 0 | 0 | 0 | 0.03 | 0.00 | 0.01 | −0.01 |
| 20 | 13900645-13900667 | 0.03 | 0 | 0.03 | 0.04 | 0.05 | 0.06 | 0.02 | 0.05 | −0.03 |
| 20 | 23109029-23109051 | 0 | 0 | 0.01 | 0 | 0 | 0.01 | 0.00 | 0.00 | 0.00 |
| 20 | 31859435-31859457 | 0 | 0.02 | 0 | 0 | 0 | 0.03 | 0.01 | 0.01 | 0.00 |
| 20 | 49558961-49558983 | 0.04 | 0.09 | 0 | 0 | 0.07 | 0 | 0.04 | 0.02 | 0.02 |
| 21 | 37176555-37176577 | 0 | 0 | 0.03 | 0.07 | 0.05 | 0 | 0.01 | 0.04 | −0.03 |
| 22 | 27735501-27735523 | 0 | 0.08 | 0 | 0 | 0.04 | 0.05 | 0.03 | 0.03 | 0.00 |

TABLE 11-continued

PCSK9 gRNA GA346 off-target site validation in human primary hepatocytes

| Chromosome | Lot #: Location | STL Treated | HLY Treated | JLP Treated | STL Control | HLY Control | JLP Control | Average treated | Average untreated | Net Editing |
|---|---|---|---|---|---|---|---|---|---|---|
| 22 | 25849024-25849046 | 0.03 | 0.04 | 0.01 | 0 | 0 | 0.02 | 0.03 | 0.01 | 0.02 |
| 22 | 22912001-22912023 | 0 | 0 | 0.01 | 0 | 0.05 | 0 | 0.00 | 0.02 | -0.01 |
| 22 | 49971621-49971643 | 0 | 0.15 | 0.06 | 0 | 0.11 | 0.03 | 0.07 | 0.05 | 0.02 |
| X | 1842130-1842152 | 0 | 0 | 0 | 0 | 0 | 0 | 0.00 | 0.00 | 0.00 |
| X | 50814798-50814820 | 0 | 0 | 0 | 0.06 | 0 | 0 | 0.00 | 0.02 | -0.02 |
| X | 23566446-23566468 | 0 | 0 | 0 | 0 | 0 | 0 | 0.00 | 0.00 | 0.00 |
| X | 83385071-83385093 | 0 | 0.08 | 0 | 0 | 0 | 0 | 0.03 | 0.00 | 0.03 |
| X | 76172984-76173006 | 0 | 0 | 0.03 | 0 | 0 | 0.05 | 0.01 | 0.02 | -0.01 |
| X | 107536875-107536897 | 0 | 0 | 0 | 0.03 | 0 | 0 | 0.00 | 0.01 | -0.01 |

Figure 14:
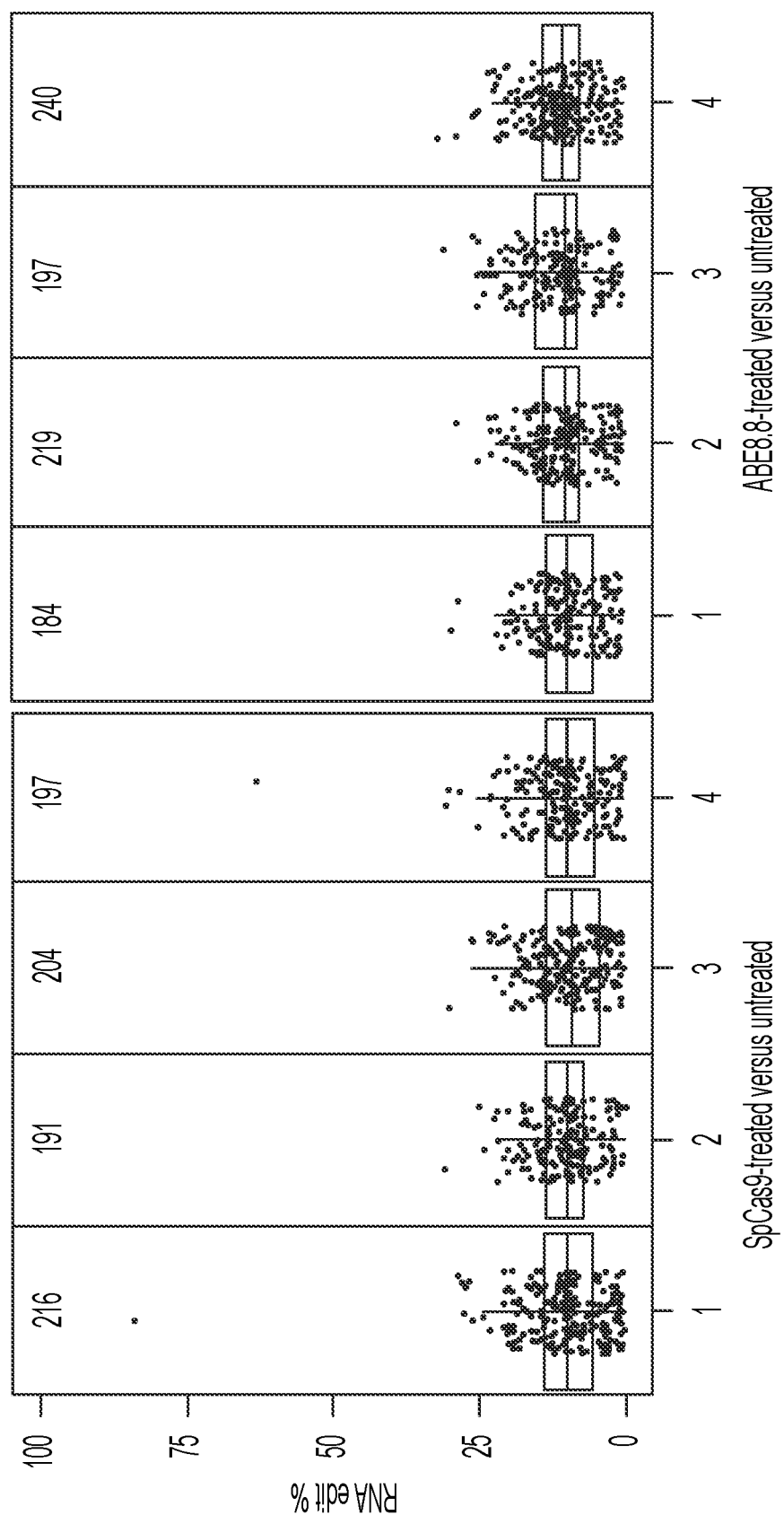
FIG. 14 depicts guide RNA-independent RNA editing, assessed in SpCas9-treated or ABE8.8-treated hepatocytes after 2 days (n=4 biological replicates). Each replicate was compared against each of four untreated hepatocyte samples to eliminate any positions with editing that were common to both conditions. The jitter plots portray transcriptomic loci with editing in the treated sample (number indicates total edited loci identified in the treated sample, boxplot indicates median ±interquartile range of proportion of edited reads across all edited loci in the sample). gRNA GA097, SpCas9 mRNA MS010, and ABE8.8 mRNA MA004 were used in this study as described in example 4.

Adenine base editors have been reported to induce gRNA-independent RNA editing via the deoxyadenosine deaminase domain. To assess for gRNA-independent RNA editing, primary human hepatocytes were treated with mRNA and PCSK9 gRNA (n=4 biological replicates), SpCas9 mRNA and gRNA (n=4), or were untreated (n=4). RNA was extracted after 2 days, and processed as described in the additional detailed methods section. Comparing the RNA profiles of the ABE8.8— and SpCas9-treated hepatocytes with untreated hepatocytes, no substantial RNA edits in the ABE8.8-treated hepatocytes was observed (FIG. 14). Each replicate was compared against each of four untreated hepatocyte samples to eliminate any positions with editing that were common to both conditions. The jitter plots portray transcriptomic loci with editing in the treated sample (number indicates total edited loci identified in the treated sample, boxplot indicates median ±interquartile range of proportion of edited reads across all edited loci in the sample).

Modifications and/or truncations to either the spacer or tracr portion of the gRNA was assessed by alteration of the GA066 spacer (5'-CCCGCACCTTGGCGCAGCGG-3' (SEQ ID NO: 13)) (Table 12). The modifications to the guide can serve to improve on-target editing efficiency and/or improve off-target editing efficiency. Each of the gRNAs with an equivalent amount of in vitro transcribed ABE8.8 mRNA (1:1 ratio by weight) were co-transfected into primary human hepatocytes and primary cynomolgus hepatocytes and processed as described in detailed methods.

TABLE 12

Modifications and/or truncations of the PCSK9 guide GA346 results in high-level editing in human primary hepatocytes

| | Human Primary Hepatocytes-Editing % at Position 6 (Dose, Replicate #) | | | | | | | |
|---|---|---|---|---|---|---|---|---|
| gRNA | 2500 ng/mL rep1 | 2500 ng/mL rep2 | 1250 ng/mL rep1 | 1250 ng/mL rep2 | 625 ng/mL rep1 | 625 ng/mL rep2 | 312.5 ng/mL rep1 | 312.5 ng/mL rep2 |
| GA346 | 30.69 | 35.58 | 19.99 | 34.67 | 27.13 | 16.93 | 12.56 | 9.92 |
| GA376 | 38.15 | 33.98 | 31.43 | 25.28 | 24.02 | 22.03 | 14.81 | 12.02 |
| GA377 | 35.11 | 37.31 | 26.39 | 31.48 | 21.39 | 23.19 | 15.34 | 14.9 |
| GA380 | 38.5 | 35.38 | 32.41 | 32.43 | 25.28 | 20.36 | 12.85 | ND |
| GA381 | 29.7 | 31.2 | 24.12 | 29.23 | 17.32 | 18.43 | 11.44 | 11 |
| GA382 | 34.56 | 30.02 | 22.5 | 24.45 | 18.48 | 15.64 | 8.45 | 8.86 |
| GA383 | 42.2 | 34.95 | 32.76 | 31.79 | 22.24 | 24.17 | 13.27 | 13.26 |
| GA384 | 8.49 | 8.5 | 7.07 | 6.51 | 5.03 | 4.25 | 2.61 | 2.7 |
| GA385 | 40.2 | 29.05 | 26.39 | 21.43 | 18.88 | 16.66 | 11.76 | 7.63 |
| GA386 | 43.73 | 30.67 | 31.57 | 26.5 | 27.51 | 19.19 | 16.94 | 13.41 |
| GA387 | 22.61 | 16.64 | 17.25 | 12.78 | 11.55 | 8.26 | 5.28 | 4.24 |
| GA388 | 28.77 | 23.84 | 20.46 | 20.33 | 13.73 | ND | 7.26 | ND |
| GA389 | 28.45 | 23.46 | 21.98 | 17.88 | 12.62 | 12.78 | 8.06 | 8.54 |
| GA391 | 25.58 | 30.06 | 25.43 | 27.3 | 27.12 | 18.67 | 16.86 | 15.78 |

| | Cyno Primary Hepatocytes-Editing % at Position 6 (Dose, Replicate #) | | | | | | | |
|---|---|---|---|---|---|---|---|---|
| gRNA | 2500 ng/mL rep1 | 2500 ng/mL rep2 | 1250 ng/mL rep1 | 1250 ng/mL rep2 | 625 ng/mL rep1 | 625 ng/mL rep2 | 312.5 ng/mL rep1 | 312.5 ng/mL rep2 |
| GA346 | 40.1 | 37.48 | 36.97 | 34.08 | 25.91 | 25.59 | 14.83 | 15.25 |
| GA376 | 29.57 | 29.57 | 27.62 | 31.98 | 23.08 | 22.29 | 15.12 | 15.75 |
| GA377 | 35.36 | 42.67 | 35.66 | 43.35 | 30.68 | 34.73 | 21.24 | 21.79 |

TABLE 12-continued

Modifications and/or truncations of the PCSK9 guide GA346 results in
high-level editing in human primary hepatocytes

| GA380 | 43.27 | 44.85 | 39.03 | 38.76 | 33.31 | 34.1 | 21.83 | 21.51 |
| GA381 | 39.45 | 47.85 | 35.82 | 41.03 | 28.42 | 31.87 | 15.51 | 18.36 |
| GA382 | 36.34 | 39.97 | 32.74 | 37.41 | 26.15 | 25.68 | 14.08 | 12.74 |
| GA383 | 39.02 | 53.37 | 35.44 | 44.23 | 28 | 33.42 | 16 | 20.03 |
| GA384 | 26.71 | 22.52 | 20.97 | 21.53 | 14.38 | 16.21 | 8.31 | 8.03 |
| GA385 | 38.44 | 37.36 | 38.31 | 31.84 | 31.97 | 28.48 | 18.23 | 17.68 |
| GA386 | 48.11 | 43.61 | 40.09 | 40.44 | 37.59 | 37.42 | 23.07 | 25.27 |
| GA387 | 27.3 | 21.08 | 23.71 | 21.53 | 16.82 | 13.62 | 7.34 | 6.03 |
| GA388 | 41.95 | 36.03 | 32.87 | 29.9 | 23.65 | 25.43 | 12.13 | 13.19 |
| GA389 | 34.62 | 33.47 | 32.15 | 29.86 | 25.87 | 23.29 | 11.17 | 12.33 |

With a view towards establishing the safety of a base-editing therapy knocking down ANGPTL3 in the human liver in vivo, a list of candidate sites in the human genome for off-target mutagenesis was assembled using two different methods. The first method used bioinformatic analysis of the human genome, identifying all sites with a PAM sequence compatible with *Streptococcus pyogenes* Cas9 (and therefore ABE 8.8) and a protospacer sequence with up to 4 single-nucleotide mismatches with the GA100 spacer sequence 5'-AAGATACCTGAATAACTCTC-3' (SEQ TD NO: 14).

The second method to generate candidate sites used an in vitro biochemical assay, ONE-seq, that determined the propensity of a ribonucleoprotein comprising the ABE8.8 base editor protein and gRNA GA441 to cleave oligonucleotides in a library. The reference human genome (GRCh38) was searched for sites with up to 6 mismatches to the protospacer sequence specified by the ANGPTL3 gRNA (5'-AAGA-TACCTGAATAACTCTC-3' (SEQ ID NO: 14)), and sites with up to 4 mismatches plus up to 2 DNA or RNA bulges using Cas-Designer were identified. More specifics on ONE-seq library preparation, experimental protocol, and bioinformatic analysis are described in the additional detailed methods section.

Oligonucleotides with higher sequence counts reflect a higher propensity for Cas9/gRNA cleavage in vitro and represent the sites most likely to suffer off-target mutagenesis in cells. The top candidate sites are identified in Table 13. Validation of candidate sites was performed using ANGPTL3 edited, and untreated human primary hepatocytes. Upon next-generation sequencing (Table 14), when the observed base editing rates in control cells were subtracted from the observed base editing rates in LNP-treated cells across the on-target site and candidate off-target sites (to account for background sequencing errors inherent in next-generation sequencing), appreciable base editing were observed at the on-target ANGPTL3 target site.

TABLE 13

ANGPTL3 gRNA (Protospacer 5'-AAGATACCTGAATAACCCTC-3' (SEQ
ID NO: 15)) candidate off-target sites identified by ONE-seq

| chromosome | location | Potential Off-target Sequence (5'-3') | SEQ ID NO: | alignment |
|---|---|---|---|---|
| 1 | 4546642 | CAGATACCATAAAAATCATCTGG | 682 | X60 |
| 1 | 6955991 | AAGATACTGAAAAACCCTGCAA | 683 | RNA41 |
| 1 | 16544549 | CAGAGAGCAGAGTAAACCTCTGG | 684 | X60 |
| 1 | 23996891 | CAGAAAACTATAACCCTCAGG | 685 | RNA32 |
| 1 | 26088616 | AGAATGGCTGCATAACCCTTGGG | 686 | X60 |
| 1 | 27386898 | AAGGTTACTTAATAAACATCTGG | 687 | X60 |
| 1 | 28115884 | AAGATACCTGAATTAAATCTCAAA | 688 | DNA41 |
| 1 | 30795252 | AAGTATCTTGAATAACCCTCCTG | 689 | X50 |
| 1 | 31542787 | CAAATAACTAAATGACCCTCTTG | 690 | X60 |
| 1 | 32826604 | AAGATACTGAAAAACTCTCTTC | 691 | RNA41 |
| 1 | 33418548 | TAGATAACCTGAATAGCCCTATAG | 692 | DNA41 |
| 1 | 45361452 | TAGATACTTCAATACCTCTCAGT | 693 | X60 |
| 1 | 57486127 | AGCAATCCTGAAAAATCCTCTGG | 694 | X60 |
| 1 | 59422147 | ACGATACTTGGATAACCCTCTGG | 695 | X30 |
| 1 | 59572755 | GAGATACCTAATAAGCCTCTAT | 696 | RNA41 |
| 1 | 62604219 | AAGATACCTGAATAACCCTCTGG | 697 | X00 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 1 | 66687653 | AAGTTACTGAATATCTCTCAGC | 698 | RNA41 |
| 1 | 76436411 | AGTATACCTCAATAACCACCTGG | 699 | X50 |
| 1 | 77254313 | AAGATCCAGAAGAATCCCCTGG | 700 | RNA41 |
| 1 | 78181978 | AGGATACCTGGAAACCCTACTGG | 701 | X60 |
| 1 | 83689742 | AAGATAACTAGCTAGCTCTCTGG | 702 | X60 |
| 1 | 89670639 | GAGATACTTGAATAAACTTCTAT | 703 | X60 |
| 1 | 93001069 | AAGATACCTGACTAACCTGTTTT | 704 | X60 |
| 1 | 97782174 | TAGATACATGATTAAACCACTGC | 705 | X60 |
| 1 | 110981606 | TATATACATGAATAACTCCGG | 706 | RNA32 |
| 1 | 114341782 | ATTATTCTTGAATAACCCCAGGG | 707 | X60 |
| 1 | 114403243 | AAGATACCTGAGAAACTCTGCAA | 708 | X60 |
| 1 | 114800896 | ATGACTGCTGAGAAACCCTCTGG | 709 | X60 |
| 1 | 114851709 | AAGAATCCTAGATATCCCTCAGT | 710 | X60 |
| 1 | 116440140 | AAAATACCAAAAAAACCCTATAG | 711 | X60 |
| 1 | 118751265 | AAGAATTTGAATAACCCTCAAT | 712 | RNA41 |
| 1 | 119001156 | AGGCTAACAGAATCACCCTCGGG | 713 | X50 |
| 1 | 150002706 | GTGATCCTGAGTAAACCTCAGG | 714 | RNA41 |
| 1 | 156332931 | TAGATACCTATAAGCCTCTGG | 715 | RNA22 |
| 1 | 162745410 | AAGATACATGAAAAAAACATTGG | 716 | X60 |
| 1 | 164962899 | AAGATACCTTAAAACCCTTCAGC | 717 | X50 |
| 1 | 165289582 | AATTTACCTGAATAGTCATTAGG | 718 | X60 |
| 1 | 167577809 | AAGATACACAAATAGCCATCAAG | 719 | X60 |
| 1 | 170883188 | AACAAACCTGAATAGTCCTACTG | 720 | X60 |
| 1 | 175232700 | CAGATATCTGAATCACTCTTCTG | 721 | X60 |
| 1 | 176788495 | AAAATATGAATAACCCTTTGG | 722 | RNA22 |
| 1 | 177848832 | CAGATACTGAGTCACCCTCAGC | 723 | RNA41 |
| 1 | 178104014 | AAGTACCTAAATACCCTTGGGG | 724 | RNA41 |
| 1 | 179507899 | AAGATACCATTCTAACCCTCTGA | 725 | X50 |
| 1 | 180840385 | AAGGTAACTAAGAAACCCTCAGA | 726 | X60 |
| 1 | 183484429 | CTCATACCACAATAACCCTCATG | 727 | X60 |
| 1 | 183743474 | AAGATAATGAATATCACCCAGG | 728 | RNA41 |
| 1 | 185824500 | AAGATACTAATAAACACTCAGG | 729 | RNA41 |
| 1 | 188687384 | CAGATACCTGAATAAGCAGAAGC | 730 | X60 |
| 1 | 194817380 | ATAATACCTGAATACTCTCAGA | 731 | RNA41 |
| 1 | 199542263 | TCTATACCTGCATAACCCTAAGG | 732 | X50 |
| 1 | 201739039 | AAGTTACCAGGAGGACCCTCAGG | 733 | X50 |
| 1 | 203127991 | AAGAGACCGGAATGCCCCCTTGG | 734 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 1 | 209196372 | AACAGGCCATAAGAACCCTCTGG | 735 | X60 |
| 1 | 209428278 | TAAATGCCAGGATAAGCCTCTGG | 736 | X60 |
| 1 | 217518556 | TACATAACTGAATAACTCTCCAA | 737 | X60 |
| 1 | 222014072 | AAGAAAGCTGAGTAAGCCCGGG | 738 | RNA41 |
| 1 | 228023082 | GGGATACCCGAATAACCCCACAG | 739 | X60 |
| 1 | 228546593 | GAGACACCTGGGTAACCCCAGG | 740 | RNA41 |
| 1 | 228724320 | GTTATACCTGAATAAATCTGGGG | 741 | X60 |
| 1 | 230479071 | AAAATACCTGCATAACCCTGAGA | 742 | X40 |
| 1 | 230750818 | CAGTTCCCTGAGTCACCCTCAGT | 743 | X60 |
| 1 | 231757688 | AAGATACATGAACTTCCCACAGG | 744 | X50 |
| 1 | 232190288 | AAAATAAGTGAATAACCCACTAA | 745 | X60 |
| 1 | 233265568 | TAGGTACCTGAGTAACTCTGCGG | 746 | X50 |
| 1 | 235139684 | AAGAAACCAGATAACCCACAGC | 747 | RNA41 |
| 1 | 238895801 | AAGATACCTGCATAATCTAGGA | 748 | RNA41 |
| 1 | 244048003 | AGGATACCTGCGTAACTCGCAGC | 749 | X60 |
| 1 | 245228289 | AAGATACCTGGAGATGCCCCTTG | 750 | X60 |
| 2 | 2541015 | AAGATATCAGAATAACTCTGGCT | 751 | X60 |
| 2 | 5866267 | CCTGTACCTGCATAACCTTCTGG | 752 | X60 |
| 2 | 11192249 | AAGATACCTAAAAAGCCCCCAGC | 753 | X50 |
| 2 | 14318310 | TAGATACCCAAATAGCCCCTCAGG | 754 | DNA41 |
| 2 | 17555591 | TCTATACCTAAATAGTCCTCAGG | 755 | X60 |
| 2 | 18083124 | AAAATACCAGAATAACCCATTTA | 756 | X60 |
| 2 | 18570047 | AAGATATCTGAATAAACTCCAAA | 757 | X60 |
| 2 | 23315873 | ATGATTATTAAATAACCCTCAAG | 758 | X60 |
| 2 | 24850333 | AAGATCCCTGATTACCATTCCAG | 759 | X60 |
| 2 | 28691746 | AAGATACCTGGCTCAACCTCATC | 760 | X60 |
| 2 | 29326137 | AATGTGGCTGAAAAGCCTCTGG | 761 | X60 |
| 2 | 30453369 | AAGATACCTAAACATTCCAGTGG | 762 | X60 |
| 2 | 31504056 | AAGAGAGCTGGACAACTCTAAGG | 763 | X60 |
| 2 | 33271364 | AAGATAGGTCAATAACCACCCGG | 764 | X50 |
| 2 | 33829479 | TAGATAACTGAATAAACTCTATGG | 765 | DNA41 |
| 2 | 35540632 | AAGATGTATTATTGACCCTCTGG | 766 | X60 |
| 2 | 38119450 | TAGAAAACAGAATGACTCTCAGG | 767 | X60 |
| 2 | 42166900 | AATAACCAAAATAACCCTCCAG | 768 | RNA41 |
| 2 | 46398173 | TATGTACCTAATAAGCCTCAGG | 769 | RNA41 |
| 2 | 49841412 | CATATATCTGAATAGCCTTCTGG | 770 | X50 |
| 2 | 56159084 | AAGATACAGAATTCCCCTCTGA | 771 | RNA41 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 2 | 56257553 | AAGTTACATGAAAAACATCTGG | 772 | RNA41 |
| 2 | 57130463 | AAAATACCTGAATAATCCTCGAA | 773 | X40 |
| 2 | 59482506 | AAGATACCAGAGAAAGTCTCAGA | 774 | X60 |
| 2 | 60290320 | CAAATACCAGAATACCCTACAGG | 775 | X60 |
| 2 | 64169496 | ATGATCCTAAATAACCTTCCAG | 776 | RNA41 |
| 2 | 68986545 | AACAACATGAATGACTCTCTGG | 777 | RNA41 |
| 2 | 71741885 | AAGATAAAGGTATCTCCCTCTGG | 778 | X60 |
| 2 | 72415642 | AAGCCAACTGAATAACACTGTTG | 779 | X60 |
| 2 | 72619690 | ATGATACCTGAATACCTCTAATG | 780 | X50 |
| 2 | 75266724 | AAGCCAACTGAAGAGCCCTTGGG | 781 | X60 |
| 2 | 80321182 | AAGAACTTGATAAACCCTCAAG | 782 | RNA41 |
| 2 | 87443936 | TTGACACCTAAATAACCCTTTGG | 783 | X50 |
| 2 | 98349660 | AAGAGACCAGAAGCAACCTCTGT | 784 | X60 |
| 2 | 100696913 | AAGAAACATGAACAGAGCCTCAGG | 785 | DNA41 |
| 2 | 104408132 | GAGATACCTGTATAAGTCACTAG | 786 | X60 |
| 2 | 108664444 | AAAATGCCTTAAGAACCCTGGGG | 787 | X50 |
| 2 | 111506561 | TTGACACCTAAATAACCCTTTGG | 783 | X50 |
| 2 | 112735695 | TAGATACTCAGTAACCCTCTTG | 788 | RNA41 |
| 2 | 115162717 | AAGAGACAGGAATAACCCTCAGC | 789 | X40 |
| 2 | 121516112 | AAAATACCATGTAAAACACTCTGG | 790 | DNA41 |
| 2 | 122492850 | GAGATACAGAATAGCCCTGGGG | 791 | RNA41 |
| 2 | 124401576 | AAGAACCTAAATCACCATTGGG | 792 | RNA41 |
| 2 | 128856709 | AAGATATCTGGATAATCCACCAA | 793 | X60 |
| 2 | 141714040 | AAGATACTGGAATAAACATAAAG | 794 | X60 |
| 2 | 143719680 | AAAATGCCTCAATATCTCTGTGG | 795 | X60 |
| 2 | 144191771 | AAAATACCAAAATAACCCTAAAG | 796 | X50 |
| 2 | 149423627 | TAGATACCTGAAATACTCTATGC | 797 | X60 |
| 2 | 153591411 | AAAATACCATAATTTCCCTCAGA | 798 | X60 |
| 2 | 154142624 | AAGATACCAAATAAACCTCTGA | 799 | RNA31 |
| 2 | 155791011 | AAGATACCTAAAATACCTATTGG | 800 | X60 |
| 2 | 155965426 | CAGATACCTGAAAAACTCTCTCT | 801 | X50 |
| 2 | 157734996 | AATAAACACTGAATAACCCTTTGT | 802 | DNA41 |
| 2 | 163699397 | CAGCTACCTAATTACCCTCTGG | 803 | RNA31 |
| 2 | 163782922 | TAGGTACCTGATTTACCCTGATG | 804 | X60 |
| 2 | 166944919 | AAGATACCTCAGGAACCAGCAGC | 805 | X60 |
| 2 | 168821195 | AAAAGACCTAAAAAGCCCTCTGG | 806 | X50 |
| 2 | 169944031 | TCAATTACTGAATAACCCTCTTG | 807 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 2 | 170941666 | AATATACATGAATAAATCTCACA | 808 | X60 |
| 2 | 173215359 | AAAAAACGTGAAAAACCTTAGGG | 809 | X60 |
| 2 | 174371138 | AAGATACCTGTTAGCCCTCACC | 810 | RNA41 |
| 2 | 176698280 | AAGTTTCATGCATAAAACTCTGG | 811 | X60 |
| 2 | 180424100 | AAGGTACCTGAAGAACTCAACTG | 812 | X60 |
| 2 | 181934742 | AAGATGTATGAATAACTCTCGGG | 813 | X40 |
| 2 | 183685747 | AAGCAACCTAAATGTCCATCAGG | 814 | X60 |
| 2 | 183737398 | GAGATACCTGGATAACCACTTGG | 815 | X50 |
| 2 | 184251994 | AAGACACCTGGAGAACTCTCGGG | 816 | X40 |
| 2 | 188364288 | AAGTAACCCAATAACCCTGAGG | 817 | RNA41 |
| 2 | 188883471 | ACAATACGTGAATGAATCCTCTGG | 818 | DNA41 |
| 2 | 191075654 | AAGATTCCAGACATACACTCTGG | 819 | X60 |
| 2 | 191371557 | TAAGTAGCTGTATAACCCTGGGG | 820 | X60 |
| 2 | 195665474 | TAAATACTTGAAAAACCCACAGA | 821 | X60 |
| 2 | 196276026 | AAGTTATCTGACTAACAATCTGT | 822 | X60 |
| 2 | 196963744 | AATATACATGAATTTCTCTTAGG | 823 | X60 |
| 2 | 197268832 | AAGATGCCTCCCTAACACTGGGG | 824 | X60 |
| 2 | 197475333 | TACATACCAACAACCCTCTGG | 825 | RNA32 |
| 2 | 198342120 | AATAGAGCTGAAAAACCCTCACT | 826 | X60 |
| 2 | 198435701 | AAATTAGATGAATAACCCTTAGT | 827 | X60 |
| 2 | 202129138 | AAAATACCTGATACCCCTGG | 828 | RNA32 |
| 2 | 202797188 | AGAGTACCTGAATACCTCTGG | 829 | RNA32 |
| 2 | 203165696 | AGAATATCTGAATTACCCTCAAG | 830 | X50 |
| 2 | 204928058 | AAGATACATGAGTAAACCCAGC | 831 | RNA41 |
| 2 | 206764957 | AGGAGACCTGCACAGGCCTCTGG | 832 | X60 |
| 2 | 216172775 | AATTTATATGAAAAACCCACTGG | 833 | X60 |
| 2 | 217541307 | AAGATACCTGATCAATCCTCTTC | 834 | X50 |
| 2 | 217737466 | AAGATACCAGACCAAAGCTCAGG | 835 | X50 |
| 2 | 220751309 | TAGAGACATGAAAAACCCTCCAA | 836 | X60 |
| 2 | 221762944 | AATATTCCTGAATCCCTCGGG | 837 | RNA22 |
| 2 | 226128392 | CTCATACCTGAATAACCTTCTCA | 838 | X60 |
| 2 | 226932531 | CAGATACCGAGAAAACCCTCTGG | 839 | DNA31 |
| 2 | 227560446 | AAGATATATGAAAAGCCTATGC | 840 | X60 |
| 2 | 228586979 | CAGATACCTCACCAACACTCCAG | 841 | X60 |
| 2 | 232730167 | CAGAGACCTGAAAGCCCTGCCG | 842 | X60 |
| 2 | 240208622 | AAAAGGCCTGCAGAAACCTCTGG | 843 | X60 |
| 2 | 241728292 | CAAATCCTTGAATCACCCCCAGG | 844 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 2 | 241778506 | AAGATACCTGGCCACACCCCAGG | 845 | X60 |
| 3 | 539550 | GAGATAATGAATAGCCCTCCGG | 846 | RNA31 |
| 3 | 7611430 | AAGATACCTGTCATCCCTCCGT | 847 | RNA41 |
| 3 | 8738135 | GGGATACCTGCATAACTCTCAGG | 848 | X40 |
| 3 | 11156153 | GAAATGCCTGAATCACACTCGAG | 849 | X60 |
| 3 | 11683514 | AAGATACTGAATCAACTTCAGT | 850 | RNA41 |
| 3 | 16474484 | AAGATACCAGTACACCCCAGG | 851 | RNA41 |
| 3 | 19871463 | ATGATACCTCAATAACCCTATTT | 852 | X50 |
| 3 | 25070750 | AAAATACCTGAACATACCTTGAG | 853 | X60 |
| 3 | 35461847 | TACATACCTAACAACCCCTCAGG | 854 | X60 |
| 3 | 35699317 | AAGAAACAAGGGAAACCCTCAGG | 855 | X60 |
| 3 | 36482333 | AAGATACCAGGATGGCTCTCTGC | 856 | X60 |
| 3 | 37570248 | CAACAACCAGAATAACCCACAGG | 857 | X60 |
| 3 | 37680767 | AAGATTAAAAGAATAAACCTCAGG | 858 | DNA41 |
| 3 | 38875399 | AACTTACCTGCAAAACCATCTGG | 859 | X50 |
| 3 | 56933123 | AAGATCTGAATTACCATCAGT | 860 | RNA32 |
| 3 | 61401423 | GAGATCCTTAACAACCCTCAAG | 861 | RNA41 |
| 3 | 64532843 | AAGATATCTGAGCCACACTCTCG | 862 | X60 |
| 3 | 68532737 | AAGCTACCTGAAAACCTTCAGG | 863 | RNA21 |
| 3 | 70442317 | AAGATGACTGAAGAAACCTTGGG | 864 | X50 |
| 3 | 70620477 | AAGATCCCTGCAAACCCTTTTGG | 865 | X60 |
| 3 | 71429771 | AAGACAGCTAAATCACCCCACGG | 866 | X60 |
| 3 | 71714408 | AAGATCACAGAATCACCCTCCTC | 867 | X60 |
| 3 | 74054464 | AATAGACATGAATAACCCTAAGA | 868 | X50 |
| 3 | 76238395 | CAGACACCTTACTAACTCTCCTG | 869 | X60 |
| 3 | 82942470 | AAGATACACAAATAAACTTCTAG | 870 | X60 |
| 3 | 83311768 | AAGATATCTGAAAACTCTCAAA | 871 | X50 |
| 3 | 84371314 | AAGACACTGAATAACCCACAGA | 872 | RNA31 |
| 3 | 86668690 | TAGATAGCAAATAACCCTAGGG | 873 | RNA41 |
| 3 | 98032158 | AATAGACCTAAATAACCTCAAG | 874 | RNA41 |
| 3 | 99319950 | AAGTTACCTGACTAACCCTGAGG | 875 | X30 |
| 3 | 100809940 | AAGATATCTGAATAACTACAAGG | 876 | X50 |
| 3 | 107069791 | AAGATACTTGGATAACTCTGCTA | 877 | X60 |
| 3 | 107509328 | AAGAGGCTGGAATAAGCCACGGG | 878 | X60 |
| 3 | 111016912 | AAGATACATAAATATCACTGCAG | 879 | X60 |
| 3 | 118950239 | CACTAACCTGAATAGCCCTAAGG | 880 | X60 |
| 3 | 120988045 | AATATACCTGAAAAACCATCAGG | 881 | X30 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 3 | 121667776 | AAAATACCTAAAGAAATTTCAGG | 882 | X60 |
| 3 | 122037269 | CGTGTACCTGAAAAGCCTCAGG | 883 | X60 |
| 3 | 126759212 | GTGAGGCCTGAAGAACACTCTGG | 884 | X60 |
| 3 | 133985020 | AAGTTACTGAATATCCCTCCAG | 885 | RNA31 |
| 3 | 140863741 | AAGAAACCGGAATGAGCCCCAG | 886 | X60 |
| 3 | 141050688 | CAGATACCAGAAGCACCCTCGAG | 887 | X50 |
| 3 | 142685343 | TAGATAACTGAAATATCCCTCTGG | 888 | DNA31 |
| 3 | 143875802 | GAGATACCCAAATAAACCTCAAA | 889 | X60 |
| 3 | 151175376 | AAGATACTGAATAAAGCTCTTA | 890 | RNA41 |
| 3 | 151226712 | AAGATAACTGAAGAAACTGAAGG | 891 | X60 |
| 3 | 151395707 | AAGATACCAGGGTAACTCTATGA | 892 | X60 |
| 3 | 155083487 | AAGATACCTGAATATCCAACCTA | 893 | X50 |
| 3 | 161319971 | AAGCTGACTGAAGAGCCCTTGGG | 894 | X60 |
| 3 | 168443226 | AGTATTTCTGACAAACCCTCAGG | 895 | X60 |
| 3 | 169534358 | GAGATAGCTAATAACCCCCTGG | 896 | RNA31 |
| 3 | 171933625 | AAGACAACTGAAAAACGCTGTGG | 897 | X50 |
| 3 | 173995167 | AAGACACCTGAATAATCTCTGGA | 898 | X60 |
| 3 | 176890998 | ATGATAAGTGAATAAGTCTCATG | 899 | X60 |
| 3 | 177768689 | AGGATATATGAAAAAGCCTGCGG | 900 | X60 |
| 3 | 187379619 | AAGATACCCTAAAAGCCTTTGG | 901 | RNA41 |
| 3 | 188484179 | AAGATGCATGAATAACCTCTGGA | 902 | X60 |
| 3 | 190699564 | ATGACACCAGAAAGACCCTAAGG | 903 | X60 |
| 3 | 192710228 | AAAATACTAAATAACCCCATGG | 904 | RNA41 |
| 4 | 723653 | CAGATTCCTGGAAGACCCTCAAG | 905 | X60 |
| 4 | 11334933 | AAGAGACCTCAAGGTCTCTCTGG | 906 | X60 |
| 4 | 12971711 | AAGACTAAAGAATAACCCTCTGG | 907 | X50 |
| 4 | 15327544 | AATATGCCTACATTACACTCAGG | 908 | X60 |
| 4 | 16411507 | AAGACACTGAATAACCCTTGGC | 909 | RNA31 |
| 4 | 20157051 | AAGATAGTGAGTAAGTCTCAGG | 910 | RNA41 |
| 4 | 23244775 | TAGATAAGAATAGCCCTCAGG | 911 | RNA32 |
| 4 | 26200297 | TCTATACCTCAATAACCTCCTGG | 912 | X60 |
| 4 | 28742386 | AAGATACCTAAGTGCTCCACAGG | 913 | X60 |
| 4 | 29008961 | AAGAAACCTACAATAACCTTCATG | 914 | DNA41 |
| 4 | 33579022 | CCGATATCAGAATATCCCTTAGG | 915 | X60 |
| 4 | 44748785 | AAGATGCATGAAAAAGCTTCAGT | 916 | X60 |
| 4 | 44812393 | TAGATATCTGCAGAACTCTCCGC | 917 | X60 |
| 4 | 45258647 | AACATACATCAATAACTTTCTTG | 918 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 4 | 46495164 | AAGATACTTGAATACCAATCAAG | 919 | X50 |
| 4 | 47192935 | TAAAGACCTGAATAACCTCAAG | 920 | RNA41 |
| 4 | 47840228 | AAGATATTGAATATACCTCAGG | 921 | RNA31 |
| 4 | 51965380 | TAGTTACCTGAATACACCTCTGG | 922 | X40 |
| 4 | 66291743 | TATATACCTGGAAAACCCTAAAG | 923 | X60 |
| 4 | 74170265 | TAGATACATAATAACCAACTGG | 924 | RNA41 |
| 4 | 84374124 | GAGATACTTGAATCCCTCAGG | 925 | RNA22 |
| 4 | 87976264 | AAGATACCTGTATGACACTGTGT | 926 | X50 |
| 4 | 88117912 | AAGATACCTAAATAACAAGCTGG | 927 | X40 |
| 4 | 90779595 | AGGATACATGCATAACCCATGAG | 928 | X60 |
| 4 | 91244542 | AAGATCCAGAATAATTCTCTGG | 929 | RNA31 |
| 4 | 91936467 | AAGATACATGAAAAATTCTCTCA | 930 | X60 |
| 4 | 93373949 | AATATACCCTAATAAGCCTTCTG | 931 | X60 |
| 4 | 93711948 | AAGATGGCTGAATAGAACCTTCCAG | 932 | DNA42 |
| 4 | 96659665 | AATATACCTTATTATCCTTCAGA | 933 | X60 |
| 4 | 100450684 | CAGATACAAGAGTACTCCTCAGG | 934 | X60 |
| 4 | 101268626 | TCTATACCTAAATAAACCTAAGG | 935 | X60 |
| 4 | 104738004 | TAGATACCTCAATAATTCTCTCT | 936 | X60 |
| 4 | 115433239 | AAATAACATAAATAACCCTCAGA | 937 | X60 |
| 4 | 115953135 | CAGAAGCTGGATAGCCCTCGGG | 938 | RNA41 |
| 4 | 136101368 | AAGAACATGAGTAACCCTAAGG | 939 | RNA31 |
| 4 | 136644335 | AAGATACTTGAAAAACACCAGGT | 940 | X60 |
| 4 | 136853658 | AAGAGAACTGAAAAGCCTCAAG | 941 | RNA41 |
| 4 | 144234750 | AAGATACCAAATAACTCTCTGG | 942 | RNA21 |
| 4 | 146835606 | AATATGCCTGTAACCCTCAAG | 943 | RNA32 |
| 4 | 149064984 | AAGCTGACTGAAGAGCCCTTAGG | 944 | X60 |
| 4 | 155932126 | AAAATTCATGAAGAACCCTGGGT | 945 | X60 |
| 4 | 157312624 | AAGATACGTGAATAACTCAGGAT | 946 | X60 |
| 4 | 159332385 | AAGATATCTGAACAATTCTAAGG | 947 | X50 |
| 4 | 160192361 | AAGATACTTGAATCACTGTCAGT | 948 | X50 |
| 4 | 168412887 | AAGATCCTGAATAATTCTCTGG | 949 | RNA21 |
| 4 | 170886954 | AAGAAGCCTGGATAGAACTCTGG | 950 | X60 |
| 4 | 172543878 | TTGATACCTGAATAACACTCCAG | 951 | X40 |
| 4 | 172763007 | AAAAAAATGAATTACCCTCATG | 952 | X60 |
| 4 | 174561024 | GAGATCCAGAATTACCCTTGGG | 953 | RNA41 |
| 4 | 181671436 | AACATACCTAAATAACTCCTGGC | 954 | X60 |
| 4 | 184625030 | AATCTACCTGATGACCCTCGGC | 955 | RNA41 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 4 | 186075007 | AAGTTAACTGTAAAACAGCCTCAGG | 956 | DNA42 |
| 5 | 6252615 | AAGAAATCTGAAAGCCCTGGGG | 957 | RNA41 |
| 5 | 7102627 | GAGATACCTGCATAACACTTAAT | 958 | X60 |
| 5 | 7274614 | CAGATAACTGAACAACCAGATGG | 959 | X60 |
| 5 | 7657678 | AACTTAGGTGATTAACCCTCACG | 960 | X60 |
| 5 | 8704833 | ATGATACTGAATAAGTCTCAGG | 961 | RNA31 |
| 5 | 9774717 | AAGATCCAGAATAATTCTCTGG | 929 | RNA31 |
| 5 | 13575913 | AGAATACCTAGTGACCCTCAGG | 962 | RNA41 |
| 5 | 16123391 | AACAGACCTTCATAGCCCTCAGA | 963 | X60 |
| 5 | 16404802 | TATATACCTAAATAACCTAGGG | 964 | RNA41 |
| 5 | 20733472 | AAGATCTCTGAAATGCCCTGAGG | 965 | X60 |
| 5 | 23248793 | AACTTAACATAATAACCTTCAGG | 966 | X60 |
| 5 | 34351741 | ATGATAGTGAATAATCCTCATG | 967 | RNA41 |
| 5 | 35773444 | AAGATACGAGAATAACCTCAAGA | 968 | X60 |
| 5 | 35946321 | AAACTACCTGGATGACCCTCTGA | 969 | X50 |
| 5 | 36662538 | AAGAAGATGAATTACTCTCTGG | 970 | RNA41 |
| 5 | 42904833 | AAGATACAGAGTAACTCTTGGG | 971 | RNA41 |
| 5 | 43693099 | GAGATAGCTGAATAATCCCTCAG | 972 | X60 |
| 5 | 45541710 | AAGATACATCAGTAAGCCACAGT | 973 | X60 |
| 5 | 55453226 | AAAATACATTAATAAAACTAAGG | 974 | X60 |
| 5 | 58609559 | AGTAGAGGTGAATAACCCTCAGC | 975 | X60 |
| 5 | 60295257 | CAGATACTTAAATAACCATAAGG | 976 | X50 |
| 5 | 61555769 | AAGAACCTGACAAGCCCTCAGA | 977 | RNA41 |
| 5 | 66999062 | AAGATCCATCAATAAACCACGTG | 978 | X60 |
| 5 | 69412657 | AAGATACTTTTAAAACCCAGTGG | 979 | X60 |
| 5 | 73013090 | AAGATCCTGAATTACTCTCAAG | 980 | RNA31 |
| 5 | 73504738 | AAGATACCTGAACAACTCCACAC | 981 | X60 |
| 5 | 75225969 | AAGCTGACTGAAGAGCCCTAGGG | 982 | X60 |
| 5 | 78444765 | TTGATACCTGTATTACACTCATG | 983 | X60 |
| 5 | 82799696 | AAGATACAGAGAATAACCCTCACA | 984 | DNA41 |
| 5 | 83300276 | AAAATACCTCACTAGCTCTCCAG | 985 | X60 |
| 5 | 85150663 | AAAATAATTGAAAAACTCTCTGT | 986 | X60 |
| 5 | 87098398 | ATAAGAACAGAATAACCTTCTGG | 987 | X60 |
| 5 | 91842929 | AAGAGTCATGCATAGCCCTCCAG | 988 | X60 |
| 5 | 105774459 | AAGATACTGAATAAACTCCTGC | 989 | RNA41 |
| 5 | 106733933 | AAGAAACACAAATAACCATCAGA | 990 | X60 |
| 5 | 108874504 | GAGATGCTGAATAACTCTCTGG | 991 | RNA31 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 5 | 112311434 | AAGATACTGAGTATCTCACAGG | 992 | RNA41 |
| 5 | 112422645 | AAGACACCAAGATAGCACCCTCGGG | 993 | DNA42 |
| 5 | 113833519 | AGTATACCTTAATACCCCCTGG | 994 | RNA41 |
| 5 | 114129926 | ATTATACCTAATAACCCTATGG | 995 | RNA31 |
| 5 | 117372593 | AATATAGCCCAATATCCCTCATG | 996 | X60 |
| 5 | 118452920 | CAGATACCTGAATGATCCTTTTC | 997 | X60 |
| 5 | 119760952 | AAGAAAGCTGAGTAGTCCTCAGA | 998 | X60 |
| 5 | 132792147 | AAGGGACAGGAAGAACCCTGAGG | 999 | X60 |
| 5 | 132904762 | AAGATAGCTGTATAACCTTTATC | 1000 | X60 |
| 5 | 137163670 | AAGTTAGCGGAACTCACCCTCAGG | 1001 | DNA41 |
| 5 | 137764269 | AAGAGAGCTAGCTAGCCCTCTGG | 1002 | X60 |
| 5 | 142640990 | AGGATTTCTGGATAACACTTTGG | 1003 | X60 |
| 5 | 143734240 | GAAGTACCTGAAAAACCCTCTGC | 1004 | X50 |
| 5 | 148112086 | GAGGTACTTGAATCACCATCAAG | 1005 | X60 |
| 5 | 151722432 | TAGCTTACTGAATAACCCTAAGG | 1006 | X50 |
| 5 | 152708508 | AAGAGGCATGAATAACCCTGTTC | 1007 | X60 |
| 5 | 153529703 | CAGTTACGAATAACCCTCAGA | 1008 | RNA32 |
| 5 | 156251323 | AAGATACTGAAAAACCCTCTGA | 1009 | RNA21 |
| 5 | 160330029 | AACAGACATGAAGAAGGCTCAGG | 1010 | X60 |
| 5 | 163829739 | ACCATACCTGAAGGACCATCTTG | 1011 | X60 |
| 5 | 164401431 | AAGAGACCTTAAAACTCTCTGT | 1012 | RNA41 |
| 5 | 165782539 | ACAAGACCAAAATAACCCACAGG | 1013 | X60 |
| 5 | 172047699 | ACGATGGCAGAACAAACCTCAGG | 1014 | X60 |
| 5 | 173042104 | AAGATACCTCAAACACCAGCCGT | 1015 | X60 |
| 5 | 175751428 | AAGACACCTAAATATCCCTGGGA | 1016 | X50 |
| 5 | 177550455 | AAGATACTGACTAATCATCTGC | 1017 | RNA41 |
| 6 | 2810238 | TAGACACCTGAGTCACCCTCTTA | 1018 | X60 |
| 6 | 3633347 | GTGATACCAGATTAACCTCTGG | 1019 | RNA41 |
| 6 | 3993855 | AGAGTAACTGAATAACCCTACAG | 1020 | X60 |
| 6 | 6543792 | TTTGTACCAGAATAACCCTCCTG | 1021 | X60 |
| 6 | 8845584 | AAATTAACTGCATAACCCTGGGT | 1022 | X60 |
| 6 | 12146644 | AAAAAACTTGAATTACCTTCTAG | 1023 | X60 |
| 6 | 13274573 | CTGAAACCTAAATAATCCCCCGG | 1024 | X60 |
| 6 | 15494007 | AAGACCCAGGAATCACACTCTGG | 1025 | X60 |
| 6 | 16159742 | AGAAGACCTGAATACCCCCAGG | 1026 | RNA41 |
| 6 | 17837365 | CAAATACCTAAAGAACTCTCCTG | 1027 | X60 |
| 6 | 18241159 | CCTATACCTAATAACCTTCAGG | 1028 | RNA41 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 6 | 20501819 | AAGATACCTGGAAAACTCCCAAA | 1029 | X60 |
| 6 | 22811364 | TAGACACCTAATAATCCCCAGG | 1030 | RNA41 |
| 6 | 24130572 | GTGATACCTGTCAGACCCTCGGG | 1031 | X60 |
| 6 | 25968782 | AAGATACCAGAATTCCCCTCTTC | 1032 | X50 |
| 6 | 26726581 | AAGATGGCTGAGAAAAACTCAGG | 1033 | X60 |
| 6 | 26775081 | AAGATGGCTGAGAAAAACTCAGG | 1033 | X60 |
| 6 | 28642665 | CGTGTACCAGAATCACCCTCAGG | 1034 | X60 |
| 6 | 28976992 | AAGAACTTGTAGAACCATCAGG | 1035 | RNA41 |
| 6 | 31728324 | AAGATACCCCATCACCCCTCCCG | 1036 | X60 |
| 6 | 31925117 | AAGATCAGCAGAAGAACCTTCTGG | 1037 | DNA41 |
| 6 | 32569518 | AGTATACCTAAACAAACCTCAGA | 1038 | X60 |
| 6 | 35414348 | AAGATCCTGCATACCCTTCTGT | 1039 | RNA41 |
| 6 | 39979448 | AAGATCCAGATTAACCCTCTAG | 1040 | RNA31 |
| 6 | 40805097 | AACATCCCTGAAGACCCTTGAGG | 1041 | X60 |
| 6 | 41733389 | AAGATACCTGGGTCCCCATTTGG | 1042 | X60 |
| 6 | 42264231 | AAGATCCTTAAATACCCTCTGG | 1043 | RNA31 |
| 6 | 42676866 | AAGATAACTAACTCACCTTCCCG | 1044 | X60 |
| 6 | 45506487 | ATGATATATGAACAACCCTCTGG | 1045 | X40 |
| 6 | 45565147 | AACATACTCGAATACCCCTCAAA | 1046 | X60 |
| 6 | 45812353 | AGCTTACCTGCTTAACCCTCAGG | 1047 | X50 |
| 6 | 45989719 | AAGATACCAAAATTCCCCAATGG | 1048 | X60 |
| 6 | 46206185 | ACGATACTGGAATAAGCCTTTGA | 1049 | X60 |
| 6 | 51499203 | CAGTACCTCAACAACCCCCTGG | 1050 | RNA41 |
| 6 | 51857715 | AATATCCTGAATAAACCTCTAG | 1051 | RNA31 |
| 6 | 57915493 | AAGACACCTGATAAAAACTCTGT | 1052 | X60 |
| 6 | 62452292 | AAGATACAGAATAAACCTAAGG | 1053 | RNA31 |
| 6 | 66308858 | GAGATACTTGAACAACTCACTGG | 1054 | X50 |
| 6 | 66899926 | AAGAAACCAGAGAAACCTTCGAG | 1055 | X60 |
| 6 | 71004311 | AAAGTACCTAAATAACCAACCAG | 1056 | X60 |
| 6 | 76467643 | AAGAAGGTGAATAACACTTAGG | 1057 | RNA41 |
| 6 | 78402401 | AAGATACCTGGCTAGCCATATGC | 1058 | X60 |
| 6 | 79368236 | AAGCTACCAGAGGAACAATCAGG | 1059 | X60 |
| 6 | 84651006 | CATTTACTGAATAACCCTTTGG | 1060 | RNA41 |
| 6 | 84877021 | GATAAACATGAAGGACCCTCAGG | 1061 | X60 |
| 6 | 89636030 | AACGTACCTGAACAACCCTCAGG | 1062 | X30 |
| 6 | 90026983 | ACACTACCTGAATGACCCTCAAG | 1063 | X50 |
| 6 | 91316610 | AATATACATGAAACACACTTAGG | 1064 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 6 | 100261928 | AAGATACCTAAATGTCCATCAAC | 1065 | X60 |
| 6 | 101477606 | CAGATATGAATAAACCTCTAG | 1066 | RNA32 |
| 6 | 104427293 | AATAGTACTCAATAAACCTCTGG | 1067 | X60 |
| 6 | 105452361 | AGTATACATGAATAGCCCTCAGG | 1068 | X40 |
| 6 | 113288211 | TTGCTACCTGAATAACCCTCTTG | 1069 | X40 |
| 6 | 125169983 | AAGATATCTGAGGAAGCGTCTTG | 1070 | X60 |
| 6 | 125494646 | AAGATACCTGAAACCCTCTGG | 1071 | RNA02 |
| 6 | 126401280 | CAGATATTGAAAAACCCTCTGG | 1072 | RNA31 |
| 6 | 127951944 | AAGGTATCCAAATAACCCTTGG | 1073 | X50 |
| 6 | 133766716 | TAAATACCTGAACAACTCTAGGG | 1074 | X50 |
| 6 | 134020048 | AAGATTACATGAGTACCCCTCCTG | 1075 | DNA41 |
| 6 | 141080346 | ATGATAGTGAATAACTCTCTTG | 1076 | RNA41 |
| 6 | 141657228 | AAGATATCTGAAAAATCCACAAA | 1077 | X60 |
| 6 | 142866995 | AAGATTTCTTATAACCCTCTGG | 1078 | RNA31 |
| 6 | 146355335 | AAGATACTCTGAATAACTTTCTGG | 1079 | DNA21 |
| 6 | 147553748 | AAGTCATCTGAATAACCCTCAAG | 1080 | X40 |
| 6 | 152311384 | AAGATACGTGCAATAACTATCAAG | 1081 | DNA41 |
| 6 | 158194025 | AAGATACATTAGTAACATTTTGG | 1082 | X60 |
| 6 | 159249441 | AAGAAACACTTAAAAACCATCTGG | 1083 | DNA41 |
| 6 | 159877092 | TAGATACCTGTATAACCACCACC | 1084 | X60 |
| 6 | 163714704 | AACTTACCTGAACATGCCCCTGG | 1085 | X60 |
| 6 | 166082374 | TAGATACATGGATTAACTTCTGG | 1086 | X60 |
| 6 | 168015970 | AAGACAGCAGTAAAACACTCTGG | 1087 | X60 |
| 6 | 168145686 | AAGATCTGGAAGAACTCTCTGG | 1088 | RNA41 |
| 7 | 5143278 | AAGAAAGGTGAGCAACACTCGGG | 1089 | X60 |
| 7 | 5180429 | AAGATACTTTAAAAAACCCCTGC | 1090 | X60 |
| 7 | 12098480 | AATATACCTAGCTAAGCCTCAGA | 1091 | X60 |
| 7 | 16189181 | AAGATAGCCTGAGTCACACTCTTG | 1092 | DNA41 |
| 7 | 17175165 | AAGAAAACAGCGTAAGCCTCAGG | 1093 | X60 |
| 7 | 18301478 | ATGAAACCTAAATAAGTCTCTGG | 1094 | X50 |
| 7 | 18326887 | TGTTTACCTGAATAACCTTCAGG | 1095 | X50 |
| 7 | 20063992 | AAGATATCTGAAAAGCCCACTTT | 1096 | X60 |
| 7 | 21393775 | TGTAAACCTGGATAACCCTCTAG | 1097 | X60 |
| 7 | 22673635 | AAGTATCATGAATACCCTCAGG | 1098 | RNA41 |
| 7 | 25237966 | AAGATCCTATATAACCCTCTGA | 1099 | RNA31 |
| 7 | 28451369 | AAAATACCTGAATAACCTGGGCC | 1100 | X60 |
| 7 | 36309411 | AAGTTACCAGAACAACCCTTAGG | 1101 | X40 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 7 | 43099959 | AAGAATTTGAATAACTCTCTAG | 1102 | RNA41 |
| 7 | 45063943 | AGGATACCTGAATCCCTCCAG | 1103 | RNA22 |
| 7 | 46108303 | GAGACACCTGAATAAGTGTCTGG | 1104 | X50 |
| 7 | 46457470 | AAGCTAGTGAAAAACCATCAGG | 1105 | RNA41 |
| 7 | 47819173 | AGGATACTTGAATATCCCTGCCT | 1106 | X60 |
| 7 | 49066063 | CAGATACTGAAAAACACTCTGG | 1107 | RNA31 |
| 7 | 49306954 | AAGAAATCTGGATAACCCCCAAT | 1108 | X60 |
| 7 | 60892285 | AACATACCCAAAAAAACCTCTGA | 1109 | X60 |
| 7 | 61597579 | AACATACCCAAAAAAACCTCTGA | 1109 | X60 |
| 7 | 62026418 | AACATACCCAAAAAAACCTCTGA | 1109 | X60 |
| 7 | 78658625 | AAAATATCCAAATAACCCCCTGG | 1110 | X50 |
| 7 | 81886792 | AAGATATCTGAATAATCATCAGG | 1111 | X30 |
| 7 | 88664778 | AAGATACTGAGTAACACTGAAG | 1112 | RNA41 |
| 7 | 89093321 | AAGTTACCTAAATAACTTTGG | 1113 | RNA32 |
| 7 | 89117479 | ACCATAATTGATTAACTCTCTGG | 1114 | X60 |
| 7 | 94742185 | AAGAAACCTAAGTAAACCTCTAA | 1115 | X60 |
| 7 | 96159184 | AAGATACATCATCACCCTCCTG | 1116 | RNA41 |
| 7 | 96499495 | AAGACACATAAGGAACCCTCATG | 1117 | X60 |
| 7 | 101395824 | GAGATACCTGAGCTGCCCTCAGC | 1118 | X60 |
| 7 | 104765414 | GAGATACCTAAATAACCTTCCAG | 1119 | X40 |
| 7 | 107527319 | AAGATACGAATAATCCTCCGA | 1120 | RNA22 |
| 7 | 114126788 | ATTAAACCAAAATAACCCTCGGG | 1121 | X50 |
| 7 | 117090821 | CACAAACCTTAATAACCCTCAAG | 1122 | X50 |
| 7 | 117393513 | AAGATAAAAAAATACCCCTAGGG | 1123 | X60 |
| 7 | 123985680 | AAGATATCTGAAAAGTCTTGAG | 1124 | X60 |
| 7 | 124105262 | GAGATAACTGAATAACCATTTGG | 1125 | X40 |
| 7 | 125205185 | AAGATATCTGTAAAACCCTTCAG | 1126 | X50 |
| 7 | 125899502 | AACATACATGAAAAATCCTCAAC | 1127 | X60 |
| 7 | 127268120 | AAGGTAACTGGATAGCCATCTGC | 1128 | X60 |
| 7 | 132695120 | AAGAGACCTGAGTCACCCTGTCT | 1129 | X60 |
| 7 | 134060777 | AAGATAAATGAATTTCCTTCTGT | 1130 | X60 |
| 7 | 140628498 | AAGATACGGGAAATCCCCTTTGG | 1131 | X60 |
| 7 | 146763269 | CAGATATCAGATAACCCTATGG | 1132 | RNA41 |
| 7 | 153436410 | CAGATGCTTGTAAAACCATCAGG | 1133 | X60 |
| 7 | 153479243 | ACAGTAGTTGCATAACCCTCTGG | 1134 | X60 |
| 7 | 155749430 | AAGATTCAGCACTAACCCACAGG | 1135 | X60 |
| 7 | 157980250 | GAGATACTGAATTACCCTCTGG | 1136 | RNA21 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 8 | 4038549 | AAGAGACATGCATAATCTTCAGG | 1137 | X50 |
| 8 | 5643554 | AAGTAAACTGAATACCTTCTGG | 1138 | RNA41 |
| 8 | 7420667 | AAGAAACCACTATAACCATCAGT | 1139 | X60 |
| 8 | 7890852 | AAGAAACCACTATAACCATCAGT | 1139 | X60 |
| 8 | 19687879 | CAGATACTGTATAACCCTCAGA | 1140 | RNA31 |
| 8 | 21016005 | AATGTAAATGTATAACCCTCTGT | 1141 | X60 |
| 8 | 29936242 | AAGTTAACTGTAAAACAGCCTCAGG | 956 | DNA42 |
| 8 | 36495615 | AGGATACCATAATAACCAGCATG | 1142 | X60 |
| 8 | 43072291 | GCAATACCTGAATAACCCATTGT | 1143 | X60 |
| 8 | 47579895 | AAGATACCAGACCATCTCCCAGG | 1144 | X60 |
| 8 | 49597827 | AAGATCTGAATAGCACCCTGG | 1145 | RNA32 |
| 8 | 55071567 | AAGATCACAGGACAACCCTCCGC | 1146 | X60 |
| 8 | 55401326 | AAGATTCATGATAACCATCATG | 1147 | RNA41 |
| 8 | 60813307 | CAGGTACCTGGAGAACCCTAGAG | 1148 | X60 |
| 8 | 61779630 | AAGATACCTGAACACCCTACTGG | 1149 | X40 |
| 8 | 64267393 | TAGCTAGCTGATAACACTCTGG | 1150 | RNA41 |
| 8 | 65828227 | ATTATACTGAATAACCTTCCAG | 1151 | RNA41 |
| 8 | 66202960 | AAGTTACCTGCATCAAACTCATG | 1152 | X60 |
| 8 | 66947451 | AAGATACAGAATAACCCTCTAG | 1153 | RNA21 |
| 8 | 67331610 | GATATACTCTAATAACCCTCAAG | 1154 | X60 |
| 8 | 67691390 | AAGATACATAAATCACTTTCCAG | 1155 | X60 |
| 8 | 67694023 | AAAATGCCTAATAGACCTCTGG | 1156 | RNA41 |
| 8 | 68072298 | AAAACACCTGAAAAATCCTCCAC | 1157 | X60 |
| 8 | 73416526 | AAGAAACACTGAATGTCCCTCTTG | 1158 | DNA41 |
| 8 | 74109927 | GTGAAACCTAAATAACCCTCAGA | 1159 | X50 |
| 8 | 75900398 | AATATACCAGAATAGTTCTCAGT | 1160 | X60 |
| 8 | 76479079 | AAGATACTGAATATTCCTCAGG | 1161 | RNA21 |
| 8 | 78222169 | GAGATACTTGAATAACCATCTCA | 1162 | X50 |
| 8 | 80098340 | AAAGTACATTAAAAACCTTCTGG | 1163 | X60 |
| 8 | 80176030 | AAGATAATTGAATAGCCATCTTA | 1164 | X60 |
| 8 | 80682169 | AACAAACCCGTAAAACCCTCACG | 1165 | X60 |
| 8 | 83187784 | AAGATAGTTAAATATCCCCCTGT | 1166 | X60 |
| 8 | 88225407 | AAGATAATAAATAACCCTCAAG | 1167 | RNA31 |
| 8 | 91354172 | AAGCTACTTGATAACCCTATGG | 1168 | RNA31 |
| 8 | 102629148 | ATTATACCTGAATCCCTCAGG | 1169 | RNA22 |
| 8 | 106844104 | AAGTTATCCTAATAACCCTATGG | 1170 | X50 |
| 8 | 106983770 | ATGTTTACTGAATACCCCTCTGG | 1171 | X50 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 8 | 108954887 | AAGGGACCTGAAATTCCCTGAGG | 1172 | X60 |
| 8 | 115458181 | TAGATAACAGAATGACTCACAGG | 1173 | X60 |
| 8 | 119894846 | AAGATTCTGAATAGACCCCAGG | 1174 | RNA41 |
| 8 | 120688940 | AACATACCCAAATACTCTCAGG | 1175 | RNA41 |
| 8 | 121544316 | AAGATACCTCAATAAGACTCGGG | 1176 | X30 |
| 8 | 124209633 | TAGATACTGAAAATCTCTCAGG | 1177 | RNA41 |
| 8 | 124951793 | AGAATACAAGAATAACCCTGGGG | 1178 | X50 |
| 8 | 125028680 | AAGATACCTGAAATTCCTGCAGA | 1179 | X60 |
| 8 | 125768967 | CTGGTACTTAATAACCCTCAGG | 1180 | RNA41 |
| 8 | 130261595 | GAGATACCTAACACACACTCTGG | 1181 | X60 |
| 8 | 139484036 | ACAATACCTGAAAAACTCCCTTG | 1182 | X60 |
| 8 | 140142948 | CAGATACATTAAAACCCTCTGG | 1183 | RNA31 |
| 8 | 141381027 | CAGAACCCACAATAAGCCTCTGG | 1184 | X60 |
| 9 | 1548217 | AATAACATGAATAACACTCAAG | 1185 | RNA41 |
| 9 | 2362898 | AAGTAACCCAAATAACCCCAGG | 1186 | RNA41 |
| 9 | 3085581 | AAGATACAGAATTTCCCTTTGG | 1187 | RNA41 |
| 9 | 7499375 | AAGGTCCCTGAGCCACCCTCCAG | 1188 | X60 |
| 9 | 7701793 | AAGATCTGGAACAACTCTCTGG | 1189 | RNA41 |
| 9 | 9668247 | AACACTATTGAATAACCATCTGG | 1190 | X60 |
| 9 | 13025629 | GGGATACCTGAATATTCTCTGG | 1191 | RNA41 |
| 9 | 13825298 | AAGATGCCTGCACATCCCTCCTT | 1192 | X60 |
| 9 | 15566128 | AAGATACATGAATTACCAAAAAG | 1193 | X60 |
| 9 | 18157881 | AAGATGCTTGAAGTAGCTTCAGG | 1194 | X60 |
| 9 | 21582692 | TAGATACCTCTTATAACCCTCCAG | 1195 | DNA41 |
| 9 | 22799849 | AAGATACATCAATAAACCTGATT | 1196 | X60 |
| 9 | 22914887 | AAGATAGTCCTATAACTCTCTGG | 1197 | X60 |
| 9 | 27875283 | AAAATTAGTGGATAAACCTCTGG | 1198 | X60 |
| 9 | 28235239 | AAGATCCTGAAGAATTCTCTGA | 1199 | RNA41 |
| 9 | 29142022 | AGAATACCTGAACAACACTCTAG | 1200 | X50 |
| 9 | 33293321 | ATTAAACCTGAAACCCTCAGG | 1201 | RNA32 |
| 9 | 33907178 | AAGATAGCTAAATAACCTCTGA | 1202 | RNA31 |
| 9 | 36483605 | GAGACAACTGATTATCCCTCAAG | 1203 | X60 |
| 9 | 39480043 | AATTTACCAGAATAGCCCTCTGA | 1204 | X50 |
| 9 | 66885197 | AATTTACCAGAATAGCCCTCTGA | 1204 | X50 |
| 9 | 74963383 | AAGATACTGAAATACCCCTATGG | 1205 | X50 |
| 9 | 81338482 | AAGGTAAATGAGTAATCCTTTGG | 1206 | X60 |
| 9 | 82995745 | AAGATTACTTGAAGAAGCCTCTGA | 1207 | DNA41 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 9 | 85121255 | AAAGTAGCTGAATAAACCTCAAG | 1208 | X50 |
| 9 | 88846233 | AAGATAACTGAAATGCCTTCGAG | 1209 | X60 |
| 9 | 89929285 | ACTATTCCTGAATAACCCTTTGG | 1210 | X40 |
| 9 | 94468528 | AACATCCTGAATCAACCTCTGC | 1211 | RNA41 |
| 9 | 96771534 | GAAATACTGAGTACCCCTCAGG | 1212 | RNA41 |
| 9 | 97299066 | TAGATCTAGAATAAGCCTCTGG | 1213 | RNA41 |
| 9 | 100767516 | AAGATACCCAAATAACCATCAGA | 1214 | X40 |
| 9 | 107058386 | AAGACAGCTAACTAACTCTCGGG | 1215 | X50 |
| 9 | 107981569 | AAAGTAGCTGAACAGCCCTCAGG | 1216 | X50 |
| 9 | 109732394 | AAGATACCTCATTAATCATCACA | 1217 | X60 |
| 9 | 110545175 | AAGATATGGAATCAACCTCAGG | 1218 | RNA41 |
| 9 | 112078020 | AAGATACCTAATAACCACAGGG | 1219 | RNA31 |
| 9 | 114633862 | ACAGCACCTGAATCACACTCTGG | 1220 | X60 |
| 9 | 114864429 | AAGATACAAAAACAACCGACTGG | 1221 | X60 |
| 9 | 114970717 | AAGATACTCAATAAACCTCAAG | 1222 | RNA31 |
| 9 | 116496855 | ATGATAGTGAATAATTCTCAGG | 1223 | RNA41 |
| 9 | 123598985 | AAGACACATAAACCACTCTCAGG | 1224 | X60 |
| 9 | 125297490 | AAGATACTGGATAACCTTCCAG | 1225 | RNA31 |
| 9 | 125378327 | ATGATAATGAATAACCCTTGGG | 1226 | RNA31 |
| 9 | 125911093 | AAGACACTGAAAAACCCTCAAG | 1227 | RNA31 |
| 9 | 127691320 | AAGATAGCAGATTAGTCCTCAGT | 1228 | X60 |
| 9 | 127974450 | AAGAGATCGGGATAAGCCTTTGG | 1229 | X60 |
| 10 | 7147046 | TAAGTACCCAAATAAGCCTCTGG | 1230 | X60 |
| 10 | 7993040 | AAGATATCTGAATATGGACCAGG | 1231 | X60 |
| 10 | 11705444 | AAGATAGCTAAGAATCCCTCCAG | 1232 | X60 |
| 10 | 13360457 | TAGTTACAAGAATAACCCCAGG | 1233 | RNA41 |
| 10 | 14735911 | TAGATACATAATAGCCCTTTGG | 1234 | RNA41 |
| 10 | 15941531 | AAGAGCCCTGAATAAGCTTTAGG | 1235 | X50 |
| 10 | 16541599 | AAGATACTGAATAAACCCGAAG | 1236 | RNA41 |
| 10 | 21114219 | AAGATATCTGGATAATCCCCAAA | 1237 | X60 |
| 10 | 27972145 | AATATACCTTGAATACCCCTCCCT | 1238 | DNA41 |
| 10 | 32570562 | GGGATACCTTAACAACCCTGTGG | 1239 | X50 |
| 10 | 35982871 | AAAATACCTGACAGAACCACTGG | 1240 | X60 |
| 10 | 38157649 | AAAATACCTGAGTGACCCTAGAA | 1241 | X60 |
| 10 | 47125548 | AAGATTTGTGAATGACCCTAATG | 1242 | X60 |
| 10 | 50305665 | AAGATACCAGTATACTCTCTGG | 1243 | RNA31 |
| 10 | 51383143 | AAGATCCCTGAACAACACCAAAG | 1244 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 10 | 54571271 | AAGATACCAGTCCCACCCTCTTG | 1245 | X60 |
| 10 | 55277105 | TAGATACTCTCAATGACCCTCTGA | 1246 | DNA41 |
| 10 | 59699528 | AAGTTACTTAAATAGCTCTCTGC | 1247 | X60 |
| 10 | 62667353 | AAGATGCTTGAATTTCCCTAATG | 1248 | X60 |
| 10 | 82421522 | AAGAGATCTGGATCACCCCCAGC | 1249 | X60 |
| 10 | 83225274 | AAGATATTTGAATATTCCCTAGG | 1250 | X60 |
| 10 | 84218985 | TAATTACCAGAATAACCCTATGA | 1251 | X60 |
| 10 | 90306612 | AAGATACCTGAAATACCTGGGT | 1252 | RNA41 |
| 10 | 94280573 | AAGGTACCTGAGTAAACATTCTG | 1253 | X60 |
| 10 | 102517636 | AAGATACATGAATGAATTCAGG | 1254 | RNA41 |
| 10 | 102734271 | CAGATACCTAAGAACCCTGACG | 1255 | RNA41 |
| 10 | 106248382 | AGTATAACAGAATAACCCTATGT | 1256 | X60 |
| 10 | 118171466 | AACATATCTGAATATCTCTCTAA | 1257 | X60 |
| 10 | 119789592 | AAGATCCTGCCTCAACCTCTGG | 1258 | RNA41 |
| 10 | 120632845 | AAGATACCAAGCTAATCCTCTGC | 1259 | X60 |
| 10 | 121862898 | GAGATTTCTGAATAACCCACCCT | 1260 | X60 |
| 10 | 121868681 | GAGAGGCCTGAGTAGCCCACGGG | 1261 | X60 |
| 10 | 122274421 | AAGGAAACTGGAGAACTCTCCGG | 1262 | X60 |
| 10 | 130321175 | AAGATACTTGAATAACCATTTCA | 1263 | X50 |
| 10 | 131549720 | TGCTTACATGAATAACCCTCCAG | 1264 | X60 |
| 11 | 2376222 | TCTGTACCTGGATAACCCCCTGG | 1265 | X60 |
| 11 | 3277015 | AAGGTAACTGACAAACCATCTGA | 1266 | X60 |
| 11 | 3322831 | AAGGTAACTGACAAACCATCTGA | 1266 | X60 |
| 11 | 3502236 | AAAATAAATGAATAAAACTGTGG | 1267 | X60 |
| 11 | 4864723 | AAGTCACCAGTTTAACACTCAGG | 1268 | X60 |
| 11 | 7440757 | AAGATACCAGAATAAATCATTCTAG | 1269 | DNA42 |
| 11 | 12052022 | TAAATACATGAATAACCATTAGG | 1270 | X50 |
| 11 | 12138824 | AAAAGCCCTGATCAAACCTCAGG | 1271 | X60 |
| 11 | 12410906 | CACTTACCTGTATAACCTCAGG | 1272 | RNA41 |
| 11 | 14162519 | AAGATACTTGCAGAACCATCTGA | 1273 | X50 |
| 11 | 15458757 | AAGATCTGAATTTCCATCAGG | 1274 | RNA32 |
| 11 | 22689538 | AAGATATACATACTAACCCTCTGG | 1275 | DNA41 |
| 11 | 22781693 | GAGTACCATAATAAACCTCAGG | 1276 | RNA41 |
| 11 | 22831675 | AAAGAACCTAAATAAGCCTCTTG | 1277 | X60 |
| 11 | 25615424 | AAGACATTAAAATAACCCACAGG | 1278 | X60 |
| 11 | 25752459 | AATATACCTGGAAAACCCACACC | 1279 | X60 |
| 11 | 26574272 | AAGACACATGAATATCACTAATG | 1280 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 11 | 26949218 | AAGATATTGAATAACCCACATT | 1281 | RNA41 |
| 11 | 26997914 | AACATCCCAGAATGACCCACAGC | 1282 | X60 |
| 11 | 28826023 | AAGAAAGCTGGCTAGCTCTCTGG | 1283 | X60 |
| 11 | 32956605 | AAGATAACTGACTTGACCCTGTGG | 1284 | DNA41 |
| 11 | 36609914 | AAGATATGAATAAAACTCTGG | 1285 | RNA22 |
| 11 | 50574461 | AAGCTATCTGAGAAACCCTTTTG | 1286 | X60 |
| 11 | 58705310 | CAGATACCTAATAACCACACGG | 1287 | RNA41 |
| 11 | 63223967 | AAGATACCTGAAATTATTTCAGG | 1288 | X60 |
| 11 | 79064018 | TTGATACCTAAATACCCTGTGG | 1289 | RNA41 |
| 11 | 80186841 | TAAATACATGAATAATCCTCGGG | 1290 | X40 |
| 11 | 81449300 | AATTAACCTACATAACCCTCAGT | 1291 | X60 |
| 11 | 83977145 | AAGATTCTTAAATAACCCACTTT | 1292 | X60 |
| 11 | 87592156 | TAGAGACATGAAAAACCCTCCAA | 836 | X60 |
| 11 | 88339518 | AAGATTTAAGAATGAACCTCAGG | 1293 | X60 |
| 11 | 88892935 | AAGATACAGAATTTCCCTTTGG | 1187 | RNA41 |
| 11 | 92568878 | TGGATACCTGTCAACCCTCTGG | 1294 | RNA41 |
| 11 | 101689415 | AAGATCCGTGAATAAACCACAGC | 1295 | X50 |
| 11 | 104364397 | AACATACACGAATACCTCACAGG | 1296 | X60 |
| 11 | 106039497 | AAGATGATAAACAACCCTCTGG | 1297 | RNA41 |
| 11 | 109887670 | TAGATCCTAATTAACCCTCAGA | 1298 | RNA41 |
| 11 | 114155888 | AAGATACAGGTGTAGCCCTCCTG | 1299 | X60 |
| 11 | 117119305 | CTGATATGTGAAAAACCCTAAGG | 1300 | X60 |
| 12 | 3649402 | AACATACTGAACCAGCCTCTGG | 1301 | RNA41 |
| 12 | 3696467 | AAGACACGAGAAGAACCTTCTGA | 1302 | X60 |
| 12 | 3830100 | AAGACACTTGAATACCACTCTTT | 1303 | X60 |
| 12 | 4704350 | TACATACCTTGATAACCTTCAGG | 1304 | X50 |
| 12 | 8120901 | AAGTTACCTGAACAAACCTGCAA | 1305 | X60 |
| 12 | 9334202 | AAAAAACTAGAAGAACCCTTTGG | 1306 | X60 |
| 12 | 10687002 | AAGATCCCTGAATTTCCATCAGA | 1307 | X50 |
| 12 | 14689862 | AAAATACCTGCATACCCTCAGG | 1308 | RNA21 |
| 12 | 20320965 | AACTTACATGAATTACTCTTAGG | 1309 | X60 |
| 12 | 22372837 | AACATTTCTCAATATCCCTTTGG | 1310 | X60 |
| 12 | 26607410 | CAGATAACTGAATAACCCTCTGT | 1311 | X30 |
| 12 | 28330833 | TAAATACCTATAACCCACTGG | 1312 | RNA32 |
| 12 | 28550781 | GAGATACCTGAATATTCTTCCAA | 1313 | X60 |
| 12 | 32209572 | ATTATATCTGAATATCCTCTGG | 1314 | RNA41 |
| 12 | 45545836 | ATGATACCCAATACCCCTCCAG | 1315 | RNA41 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 12 | 47016633 | CAGATACCTGAATCTCCTTCTTT | 1316 | X60 |
| 12 | 49068780 | CAGTTACCTGGATAACTCCCTGG | 1317 | X50 |
| 12 | 54882194 | AAAATACTAGAATAACCAGCTTG | 1318 | X60 |
| 12 | 61361291 | AAGACTCAGGAATATCACTCAGG | 1319 | X60 |
| 12 | 66409389 | AAGATCCAGAAGAATCATCTGG | 1320 | RNA41 |
| 12 | 72361250 | AAAACACCTGAATAAATCCCATG | 1321 | X60 |
| 12 | 73122159 | AACATCACTGAAGAACCCTGAAG | 1322 | X60 |
| 12 | 74390201 | AAAATACCTCATAGCCCTCTGC | 1323 | RNA41 |
| 12 | 77975069 | AAAATAGCTTAATAATGCTCAGT | 1324 | X60 |
| 12 | 78463857 | AAGTTCCCTGAACACACCTCTGG | 1325 | X50 |
| 12 | 79756510 | ACTATACTGACTAACCCTCTAG | 1326 | RNA41 |
| 12 | 79913270 | AGAATATCTTCATAACCTTCGGG | 1327 | X60 |
| 12 | 81976639 | AGAAACCTGAATAACCTATGG | 1328 | RNA41 |
| 12 | 87296671 | AAGATATTCAAATAACCCTGCTG | 1329 | X60 |
| 12 | 98856708 | GAGATACTGAATAACCTCTGGG | 1330 | RNA41 |
| 12 | 105221258 | AAGATAGCTGCTAACCCTGAGT | 1331 | RNA41 |
| 12 | 106415644 | AAAATAAATGAATAACCATCAGA | 1332 | X50 |
| 12 | 109568847 | AAGGTACTAGAAAACCCTGTGG | 1333 | RNA41 |
| 12 | 124304548 | AAGACACTGCCAAACCCTCCGG | 1334 | RNA41 |
| 12 | 128916634 | AAGATACATGAATGGCCAACGCG | 1335 | X60 |
| 12 | 131173514 | CAGAGACCTGCATAGCACTGAGG | 1336 | X60 |
| 12 | 131502294 | AAGATATCTGAAAATCCCTGCGC | 1337 | X50 |
| 13 | 20297900 | AAGAACACTGAGAAAACCCTCTGG | 1338 | DNA41 |
| 13 | 22964102 | AAGAAACCTCCATATCCATCGTG | 1339 | X60 |
| 13 | 24389118 | AAGAAACCTCCATATCCATCGTG | 1339 | X60 |
| 13 | 25266108 | AAGGTACCTTAACAACATTTTGG | 1340 | X60 |
| 13 | 26448879 | AAGGTGACTGAAGGACCCTTGGG | 1341 | X60 |
| 13 | 26553083 | ACGATAACTGAACAGCTCTCAAG | 1342 | X60 |
| 13 | 34458374 | AAGAGGGCTTAATAACCTTCAAG | 1343 | X60 |
| 13 | 39980150 | AAGATAACTGGATAGCTCTATGA | 1344 | X60 |
| 13 | 43747762 | AAGATTCAGCAATACCCTCTGG | 1345 | RNA41 |
| 13 | 50325631 | CAAAAACCAGAAAACCCTCAGG | 1346 | RNA41 |
| 13 | 60126783 | CATATACCAAAATAACCCATGGG | 1347 | X60 |
| 13 | 61481200 | AAAATACAAATAACCCTCAGA | 1348 | RNA32 |
| 13 | 66207288 | AAAATACCTGAATAAACCTGAAG | 1349 | X40 |
| 13 | 68049114 | AAGATAACTTAATAGGCCTCCAC | 1350 | X60 |
| 13 | 68754577 | AAGATGGCTGAAAAAGCCTTTCG | 1351 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 13 | 74802880 | AAGCTGACTGAAGAGCCCTTGGG | 894 | X60 |
| 13 | 77274559 | AAGTTACCAGATAACCCACAGG | 1352 | RNA31 |
| 13 | 84432474 | CAGATACCTGGTTAAACATCACG | 1353 | X60 |
| 13 | 86737129 | AAGATACATGAATGGCCAACAGG | 1354 | X50 |
| 13 | 92119936 | AAGCTACCAGCATAGCCCACTAG | 1355 | X60 |
| 13 | 109759900 | AAGAAAGCTGGAAAACACTCCAG | 1356 | X60 |
| 13 | 111418659 | AAGATGCCTGAGTCTCCCCCGTG | 1357 | X60 |
| 13 | 112083112 | AAGGAAACTGAATAACCCTCAGA | 1358 | X40 |
| 13 | 113351476 | CTGAGAACTGAATAAACCTCGAG | 1359 | X60 |
| 14 | 18485266 | AAGGTTACAGAATAAAACTCTGG | 1360 | X60 |
| 14 | 20357994 | CAGGATACTGAATAACCCTCAGA | 1361 | X60 |
| 14 | 21233079 | CCATTACATGAATAACCTTCAGG | 1362 | X60 |
| 14 | 22348176 | AAGACACCTGGATAACCATCAGG | 1363 | X30 |
| 14 | 26263145 | AAATTATGAAAAACCCTCAGG | 1364 | RNA32 |
| 14 | 30878091 | AAGATACTTGACAACTCTCTGA | 1365 | RNA41 |
| 14 | 31153973 | AAGATAGATGAATGACCCACTAC | 1366 | X60 |
| 14 | 35231283 | AAGATACTTAAATGATCCTTGGC | 1367 | X60 |
| 14 | 37392538 | AATATACCTAAATAACTTACAGC | 1368 | X60 |
| 14 | 40710593 | AAGATAACTGGATAGCCATATGC | 1369 | X60 |
| 14 | 40860782 | AACAAACATGAAAAACACTCAGC | 1370 | X60 |
| 14 | 41931495 | AAGATACCTAAATATATATCTGA | 1371 | X60 |
| 14 | 42141012 | AGGATGACTGAAAAATCCCCAGG | 1372 | X60 |
| 14 | 49513652 | AAGATGACTGCTTAACCCCCAGT | 1373 | X60 |
| 14 | 51112581 | AAGATACCAAAATGTAACTCAGG | 1374 | X60 |
| 14 | 52885591 | AAGATAACTTAAAAACTCTAAGG | 1375 | X50 |
| 14 | 52900831 | ACAGAACCTGAATAGCCCTAGGG | 1376 | X60 |
| 14 | 53020328 | AAGATGCCTGAACTAGTCCTTGGG | 1377 | DNA41 |
| 14 | 56099999 | AAAATAACTGAAAACCCTCAAC | 1378 | RNA41 |
| 14 | 59879739 | AACATACATCCACAACCATCAGG | 1379 | X60 |
| 14 | 64921531 | AAGATACATGAATAAGCACCATG | 1380 | X50 |
| 14 | 66348379 | CATATACTTGAATAACCAACTGG | 1381 | X50 |
| 14 | 68160233 | AAGATCTTAATAATCATCTGG | 1382 | RNA32 |
| 14 | 72604917 | AAGAAACCCGAGTCCCTCTGG | 1383 | RNA32 |
| 14 | 74660460 | AAGATATCTCATATCACTCAGG | 1384 | RNA41 |
| 14 | 74867740 | ACAATACCTTGAATAACCCACAAG | 1385 | DNA41 |
| 14 | 77627074 | AAGATACATAAATAACCTCACAG | 1386 | X60 |
| 14 | 80214772 | AAGTAACAGAATAATCCTAAGG | 1387 | RNA41 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 14 | 81206628 | GAATAACCTGAATAACCCCAGA | 1388 | X60 |
| 14 | 82199597 | AAATTACCTAAATAACCCAAGGC | 1389 | X60 |
| 14 | 82935226 | AAGGTACCTGAATATTGTTCTGT | 1390 | X60 |
| 14 | 84727246 | AAGACAGCTGGGTATCTCTCTGG | 1391 | X60 |
| 14 | 87353900 | CTGATAGTGAATAAGCCTCAGG | 1392 | RNA41 |
| 14 | 87564479 | ATGATAGTGAATAAGTCTCAGG | 1393 | RNA41 |
| 14 | 90316482 | TAGATATTTGAATAACCATTTAG | 1394 | X60 |
| 14 | 94330884 | AAGATGCCCTGAGCAACCCTCCTG | 1395 | DNA41 |
| 14 | 100626641 | ATGATCTCTGAATGGCCTTCAGG | 1396 | X60 |
| 14 | 104781000 | CGTGTACCTGAATGACCCACGGG | 1397 | X60 |
| 14 | 106194663 | TAGATACTGAGAAAGCCTCTGG | 1398 | RNA41 |
| 15 | 26338242 | AAGTTATCTAAAAACCCTCTAG | 1399 | RNA41 |
| 15 | 26400480 | AAGATATCTGAAAAATTCTCAAA | 1400 | X60 |
| 15 | 36010542 | AAGTAAACTGAAAACCTTCTGG | 1401 | RNA41 |
| 15 | 37986317 | AATATAACTGAATAAAACTCTTT | 1402 | X60 |
| 15 | 38076935 | TAGCTACATGAAAACCCTGGGG | 1403 | RNA41 |
| 15 | 40609022 | ATAATACTGAATAACCCTTTGA | 1404 | RNA41 |
| 15 | 43079813 | CTTTTACCTGAATACCCTCAGG | 1405 | RNA41 |
| 15 | 44348352 | AAGATGACTGAAGAGCCCTTGGG | 1406 | X50 |
| 15 | 49430075 | ATGAGCCCAGAAGAACCCTCTTG | 1407 | X60 |
| 15 | 57756788 | GAGATACCTGAAAAATCCTGGCT | 1408 | X60 |
| 15 | 58607272 | TGTATACCAGAATCACCCTAGGG | 1409 | X60 |
| 15 | 60876750 | CAGATACCTGGTAACTCTCAGG | 1410 | RNA31 |
| 15 | 61064287 | AAATTACCTGGACAACCTTCGCG | 1411 | X60 |
| 15 | 63004747 | AAGATACATGAATAACCTTGTCA | 1412 | X50 |
| 15 | 63156318 | AAGATACATTAGAACCCTCTGT | 1413 | RNA41 |
| 15 | 69510497 | AAGATATATGAATGGCCCTGAAG | 1414 | X60 |
| 15 | 71127689 | AAGATACACAAACAGCCCACAGG | 1415 | X60 |
| 15 | 73446678 | AACATACCTGAAAAAACCTCAGC | 1416 | X40 |
| 15 | 74253079 | AGGATTCCAGAAGAAGCCTGTGG | 1417 | X60 |
| 15 | 75470662 | AAGAAACCTGGATTTACCTCTGT | 141 | X60 |
| 15 | 77101670 | AGAATAGCTGAAGGACCCTGGGG | 1419 | X60 |
| 15 | 84875080 | AGGATGCCAGGGTAACCCACTGG | 1420 | X60 |
| 15 | 85440610 | TAGGTACCTGAATGACCTCAGG | 1421 | RNA31 |
| 15 | 85452623 | AAGATACCTGACATACCCTCCCC | 1422 | X50 |
| 15 | 90002805 | GAGATACATGAATGACCCTTTCA | 1423 | X60 |
| 15 | 94867496 | GTGATAGTGAATAACTCTCAGG | 1424 | RNA41 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 15 | 96462615 | AGGAAAGCTGAATAACTCTCTTA | 1425 | X60 |
| 15 | 96700894 | AAGAAACGCTAATAAACCTCAGG | 1426 | X50 |
| 15 | 99174006 | AACATTCCACACTAACCATCAGG | 1427 | X60 |
| 16 | 2950487 | AAGATACGAGAGAAACGCCCGGG | 1428 | X60 |
| 16 | 7926633 | CAATTACCAGAATAACCCACAGA | 1429 | X60 |
| 16 | 11910562 | AAGAGATTTGATAACCTTCTGG | 1430 | RNA41 |
| 16 | 14200710 | AAGATTCCTGATTCAGCCTCTGA | 1431 | X50 |
| 16 | 15502916 | AAGAAGCCAGACTAACACTGGGG | 1432 | X60 |
| 16 | 15969961 | CAAATAAATGAATAATCATCAGG | 1433 | X60 |
| 16 | 16048075 | AAGAGGCCTGACTCTCCCTCCAG | 1434 | X60 |
| 16 | 17024068 | AAGATACTTGTATAACCTCAAGA | 1435 | X60 |
| 16 | 17094952 | AACATACCTGAACAACCCTCAGG | 1436 | X20 |
| 16 | 22614186 | AAGATATTTATATACCCCTCCAG | 1437 | X60 |
| 16 | 24555817 | TAGTTACATGAAGAAACCTCTAG | 1438 | X60 |
| 16 | 25905845 | AAGATACATGCGTGAAGCCTCTGG | 1439 | DNA41 |
| 16 | 26382131 | ATGGTACCTGTACAAACTTCAGG | 1440 | X60 |
| 16 | 27966927 | AAGGCACCTGAAAGCTCTCTGG | 1441 | RNA41 |
| 16 | 35693983 | GAGATACCTGGAAAACCCCAGGC | 1442 | X60 |
| 16 | 46657396 | ATGTTAACAGAAGACCCCTCTGG | 1443 | X60 |
| 16 | 47691992 | TAGATAACTGGATACCCCACTGC | 1444 | X60 |
| 16 | 49245974 | AAAATTCCTGTCCAGCCCTCTGG | 1445 | X60 |
| 16 | 49984669 | AGGATGCCTGAAAAAACCTCAAA | 1446 | X60 |
| 16 | 51935176 | AAGATACATGAGAACCCTTTGC | 1447 | RNA41 |
| 16 | 52525199 | AAGATACATGAATAGCCCTCCAC | 1448 | X40 |
| 17 | 5340518 | TAAATACCTGAATAACCCATAGT | 1449 | X50 |
| 17 | 5857462 | TATATACATGTATAACCCACAGG | 1450 | X50 |
| 17 | 6194882 | AAGATACATTCTTAGCCCTCAAG | 1451 | X60 |
| 17 | 7932420 | AAGAAACCTTGTGAACCCTCAGT | 1452 | X60 |
| 17 | 14407307 | AAGAAATGGATAGCCCTCTGG | 1453 | RNA32 |
| 17 | 21332996 | AAAATAGCTTAAAAAGCCTGTGG | 1454 | X60 |
| 17 | 27457685 | AGGGTGCCCCAACAACCCTCGGG | 1455 | X60 |
| 17 | 28706042 | AAGAAATGTGGGTAAGCCTCAGG | 1456 | X60 |
| 17 | 29645114 | ATCATATCTGAATAACTCTCAAC | 1457 | X60 |
| 17 | 32458400 | AACAAGCCTGTATAACCCTCATG | 1458 | X50 |
| 17 | 34969762 | GTGATACTGAATAAGTCTCAGG | 1459 | RNA41 |
| 17 | 37872545 | AACATACATGAATAATCTTCAAA | 1460 | X60 |
| 17 | 39300993 | ATTATACCTCAATATCCCTCTGG | 1461 | X40 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 17 | 44931191 | AAGATACATGAAAAACACTGGCT | 1462 | X60 |
| 17 | 47455028 | AACATACATGAATAATCTTCAAA | 1460 | X60 |
| 17 | 47541148 | AAGATACCTGTACAACACTATAC | 1463 | X60 |
| 17 | 54308512 | CAGATACCTCATTTACCCTGATG | 1464 | X60 |
| 17 | 65806019 | CAGATACTTATAACCCTCTGG | 1465 | RNA22 |
| 17 | 67990176 | AAAATACTTGAAAATCCCTCAGT | 1466 | DNA41 |
| 17 | 70972434 | AAGATCAAGAATAACTGTCAGG | 1467 | RNA41 |
| 17 | 81310828 | AAGACACTTGTCTAGTCCTCTGG | 1468 | X60 |
| 18 | 8119646 | AAGAATCCGGAAAAACCCTATGC | 1469 | X60 |
| 18 | 10478571 | AAGACAGCTGGAGAACTCTCAGG | 1470 | X50 |
| 18 | 11443150 | AAGAAAAATGAACAAACCTCAGA | 1471 | X60 |
| 18 | 11651294 | AAGTTACGTGAATAGGACTCAGT | 1472 | X60 |
| 18 | 13336259 | AAGATAAAGAACAACTCTCTGG | 1473 | RNA41 |
| 18 | 21942917 | CAGATACACAGATAACCCCCAGG | 1474 | X60 |
| 18 | 24883127 | AAGAAACTTGAAAAATCCCAGG | 1475 | RNA41 |
| 18 | 35027674 | CAGATAACAGAAAAACCCTGTTG | 1476 | X60 |
| 18 | 36792668 | AAGATACCCAGATCCCCCTCCAG | 1477 | X60 |
| 18 | 36915438 | TAGATATTCTGAATATACCTCTGG | 1478 | DNA41 |
| 18 | 39891882 | CAGATACATGAAATAATCCTCCAG | 1479 | DNA41 |
| 18 | 40348238 | AGTCATCCTGAATAACCCTCATG | 1480 | X60 |
| 18 | 47612935 | GCCATACCAAATAACCCTCTGG | 1481 | RNA41 |
| 18 | 49237013 | AAGATACCTGGATAAGCAACTGC | 1482 | X50 |
| 18 | 49759577 | AAGAAACCTATAGAACCCTGAGT | 1483 | X60 |
| 18 | 52354807 | AAGAAAACAGAATAAACCTCTAA | 1484 | X60 |
| 18 | 53136651 | AAGATACCTTATCAACCCTAAAG | 1485 | X50 |
| 18 | 54113085 | CAGAAATATAAAAAACCCTCAGG | 1486 | X60 |
| 18 | 55667190 | AAGATTCAAGAAAGACCCTCTGC | 1487 | X60 |
| 18 | 56622476 | TAAATACTGAATAACCCTGTGA | 1488 | RNA41 |
| 18 | 58463120 | GAGATCTCAGCATAACTCTCTGG | 1489 | X60 |
| 18 | 66313025 | AAGATACCTTATTTACCTATGG | 1490 | RNA41 |
| 18 | 68281088 | TTCATACCTAAATAACCCTTAGA | 1491 | X60 |
| 18 | 69322487 | AAGATACCTGAATAACCTAAGAC | 1492 | X50 |
| 18 | 74469327 | AAGATACATAATAATCATCTGT | 1493 | RNA41 |
| 18 | 77464690 | AAGAGCCCTTGCTAACCATCTGG | 1494 | X60 |
| 19 | 11998269 | AAAGTATCTGAATAACACTTCTG | 1495 | X60 |
| 19 | 12455264 | AGCCTACCTAAATAGCCCTAGGG | 1496 | X60 |
| 19 | 27693648 | CAGACACCTGAATGACCCCAGGC | 1497 | X60 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 19 | 28546228 | CACTGACCTGAATCACCCCCAGG | 1498 | X60 |
| 19 | 37641018 | GAAATACTGAATAATCCTCAGG | 1499 | RNA31 |
| 19 | 38143521 | AAGACACAGAAAGATCCCTCTGG | 1500 | X60 |
| 19 | 42798163 | AAGGTACCAGATGAGCCCTTGGG | 1501 | X60 |
| 19 | 45644796 | AGGATACCTCCCAAATCCTCTGG | 1502 | X60 |
| 19 | 46147476 | CAAATACTTGAAAAGCCCTCGAG | 1503 | X60 |
| 19 | 52963761 | TAAATATGAATGACCCTCAGG | 1504 | RNA32 |
| 19 | 53485175 | CAGATATCTGAAGATCCCTCCAG | 1505 | X50 |
| 20 | 1471262 | ACAGAACCTGTATAACCCTCCAG | 1506 | X60 |
| 20 | 2545286 | AAGAAATCTAGAATACCCCTAGGG | 1507 | DNA41 |
| 20 | 6093655 | AAGTTAAATGAATGACCCTGACCGG | 1508 | DNA42 |
| 20 | 7232430 | AAGATATTTGATCAACCCTTGGA | 1509 | X60 |
| 20 | 10350390 | AGGTAACATCAATATCCCTCCGG | 1510 | X60 |
| 20 | 12411793 | AACGTACCTGAATAACTCATAAG | 1511 | X60 |
| 20 | 13449167 | AAGATACCAGCATAGTCCTCCTG | 1512 | X50 |
| 20 | 13559179 | AAGATATCTGAAGAGCCTTCCCA | 1513 | X60 |
| 20 | 18449496 | AAGATACCTGAATTTACCATGAG | 1514 | X60 |
| 20 | 19443923 | AAGATACTTTATTAACTCTCAAG | 1515 | X50 |
| 20 | 22704701 | TAGATATGTGAATTAACTTCTGG | 1516 | X60 |
| 20 | 23658111 | AAGATACCTGATCACACATCAGA | 1517 | X60 |
| 20 | 37569891 | CAGATACCTCAATAACCCTGATG | 1518 | X40 |
| 20 | 44858917 | AAGATACTTGGATAATGCTTGGT | 1519 | X60 |
| 20 | 45794486 | AAGGTATCTGAATTACCCTCAAG | 1520 | X40 |
| 20 | 52287275 | CTGAGACCTGAGTAACTCTCATG | 1521 | X60 |
| 20 | 56292197 | AAGAAAATGAATAACCCTACAG | 1522 | RNA41 |
| 20 | 60198378 | TAGATACATGAAAAACCCTTCAG | 1523 | X50 |
| 20 | 60509505 | TAGATGCTTAAATGACCCTCTGC | 1524 | X60 |
| 21 | 17021098 | TAGGATCCTGGATAACCCTCCAG | 1525 | X60 |
| 21 | 17566032 | TTGATACTTGAATAACCATCTGA | 1526 | X50 |
| 21 | 17907925 | AAGAAACCAATAACCCTCAGG | 1527 | RNA12 |
| 21 | 19274949 | AAGGAACCAGAATTACTCTCAGT | 1528 | X60 |
| 21 | 24464330 | CAGAAACCAGAATAACCTTCAGG | 1529 | X40 |
| 21 | 24537041 | AAAATTCCTGAATAGCTCTCTGG | 1530 | X40 |
| 21 | 26666529 | TAGAGACATGAAAAACCCTCCAA | 836 | X60 |
| 21 | 30710727 | ATGATAGTGAATAACACTCATG | 1531 | RNA41 |
| 21 | 30757521 | AGGATACAGAATATCCATCTGG | 1532 | RNA41 |
| 21 | 31767749 | AATCTACCTGAAAAGCCCTCTGG | 1533 | X40 |

TABLE 13-continued

ANGPTL3 gRNA (Protospacer 5'-AAGATACCTGAATAACCCTC-3' (SEQ ID NO: 15)) candidate off-target sites identified by ONE-seq

| chromosome | location | Potential Off-target Sequence (5'-3') | SEQ ID NO: | alignment |
|---|---|---|---|---|
| 21 | 33249604 | CTGATACCAGATAACCCTGAGG | 1534 | RNA41 |
| 21 | 45566319 | CAGATATCTGAATAACCCACCAG | 1535 | X40 |
| 21 | 46274280 | AAGATACATGGATAATGTTCAGG | 1536 | X50 |
| 21 | 46379614 | AAGAAACATGAAGAAAACTCAGC | 1537 | X60 |
| 22 | 15415612 | AAGGTTACAGAATAAAACTCTGG | 1360 | X60 |
| 22 | 16210764 | AAAATACATGGAAAATCCTCATG | 1538 | X60 |
| 22 | 18016369 | ATTATACCTGAATAAACCTGACT | 1539 | X60 |
| 22 | 22356999 | GATTTACCAGAAAAACCCTCTGG | 1540 | X50 |
| 22 | 22409053 | GATTGACCAGAATAACCCTCTGG | 1541 | X50 |
| 22 | 26261319 | AAGATACATCGAATAACCCTTCTA | 1542 | DNA41 |
| 22 | 31956781 | AAGGCAACTGAAGATCCTTCAGG | 1543 | X60 |
| 22 | 48095647 | AAGATATCTGAATTCAGCTCTTG | 1544 | X60 |
| X | 3121703 | AAGAAAACAGAATAAACCTCTCA | 1545 | X60 |
| X | 3288787 | AAGATAGCTGATGAAATATCAGG | 1546 | X60 |
| X | 6286346 | ATGATAGTGAATAAGCCTCAGG | 1547 | RNA31 |
| X | 15276107 | AAGATTCATGTACAAACCTCATG | 1548 | X60 |
| X | 18754961 | AAGACACATGAAGAAAACTGAGG | 1549 | X60 |
| X | 19389428 | AAGTTGACTGAAACCCTCTGG | 1550 | RNA32 |
| X | 25123524 | GAGATACCCTAGATAACCCTCAGA | 1551 | DNA41 |
| X | 33500389 | GTGATAACTGAATAACCCTGCTC | 1552 | X60 |
| X | 57574816 | GAGATAACTGCATAGCCCTAGGT | 1553 | X60 |
| X | 58085053 | GAGACACCTGAACGACCTCAGG | 1554 | RNA41 |
| X | 58098997 | AAGACACCTGACTAACCCCAGGC | 1555 | X50 |
| X | 58100889 | AAGACACCTGACTAACCCCAGGC | 1555 | X50 |
| X | 58123415 | TAGACACCTGAACAACCCCAGGC | 1556 | X60 |
| X | 58198267 | AAGACACCTGGCTGACCCCAGG | 1557 | RNA41 |
| X | 58199277 | AAGACACCTGAGCAACCTCAGG | 1558 | RNA31 |
| X | 58401983 | AAGATATCTGAGCAACACTCTGT | 1559 | X50 |
| X | 63325513 | GAGATATGTGAATAAAACTCTGA | 1560 | X60 |
| X | 63786600 | CAGAAGCTGAATGACCCTTTGG | 1561 | RNA41 |
| X | 63945361 | AAAATAACTGATAAATCCTCTGA | 1562 | X60 |
| X | 65679966 | AAGCTCCTGCATAGCCCACAGG | 1563 | RNA41 |
| X | 70140322 | AACATACCTAAATATACCCTGG | 1564 | RNA41 |
| X | 70754250 | AAGCTGACTGAAGAGCCCTTGGG | 894 | X60 |
| X | 72198434 | TAGATACCTGACTTTCCCACTTG | 1565 | X60 |
| X | 73418101 | AAGATTCCTGAAGCCTCCTCAGA | 1566 | X60 |
| X | 73819519 | CATATACTGAATAACCATCTGG | 1567 | RNA31 |

TABLE 13-continued

ANGPTL3 gRNA (Protospacer 5'-AAGATACCTGAATAACCCTC-3' (SEQ
ID NO: 15)) candidate off-target sites identified by ONE-seq

| chromosome | location | Potential Off-target Sequence (5'-3') | SEQ ID NO: | alignment |
|---|---|---|---|---|
| X | 84823869 | AAGATATCTGAAATGCCCTAGAG | 1568 | X60 |
| X | 89194879 | AAATAGCCTGAATAACCCTAGTG | 1569 | X60 |
| X | 89316606 | AACAAACATGAATAACACTAAGC | 1570 | X60 |
| X | 91030898 | AAGAAATCTGACAAACCTTTAGG | 1571 | X60 |
| X | 91177495 | GTGATACTGAATAAGTCTCAGG | 1459 | RNA41 |
| X | 99969578 | AAGATCCAGAAGAACTCTCTGA | 1572 | RNA41 |
| X | 107292941 | TAGATACCTAAATAGCCCATGGG | 1573 | X50 |
| X | 108681302 | AAGAAACCTCTATAAGCCTCTTA | 1574 | X60 |
| X | 109943949 | AATCTACTGAATAACTCTCAGG | 1575 | RNA31 |
| X | 111810669 | ATGAATACTGAATAACATTCAGG | 1576 | X60 |
| X | 113640910 | AAGATACCAATAACCCTCAAA | 1577 | RNA22 |
| X | 117399450 | AATGTACCCGAACAACCCTCAGG | 1578 | X40 |
| X | 120228774 | CAGATAGCTGAAAGAACACTCAGG | 1579 | DNA41 |
| X | 125113165 | AACATAACTGAATAACCATAAGG | 1580 | X40 |
| X | 126715614 | AATCAACCTGAATATCCATCAGT | 1581 | X60 |
| X | 130340267 | AAGATACCCATTCACCCTCTGG | 1582 | RNA31 |
| X | 130463899 | AAAGAACCTAAAAAACCCTCTTG | 1583 | X60 |
| X | 132229997 | AAGATAGGGGAAAGCCCTCTGG | 1584 | RNA41 |
| X | 138021160 | AAGGCAAATGAATAACCCACAGC | 1585 | X60 |
| X | 139830410 | AAAATACAAATAACCCTCAGT | 1586 | RNA32 |
| X | 144953782 | AAGATCCAGAAGAATTCTCTGG | 1587 | RNA41 |
| X | 150328565 | AGAATACCTGAATACCCCCAGA | 1588 | RNA41 |
| X | 154034869 | CAAATACCTTAATCACCATGAGG | 1589 | X60 |
| Y | 4605941 | AAGAAATCTGACAAACCTTTAGG | 1571 | X60 |
| Y | 4641256 | GTGATACTGAATAAGTCTCAGG | 1459 | RNA41 |
| Y | 6194908 | AAGATGCCAACATAAAGCTCAGG | 1590 | X60 |
| Y | 13359292 | TAAATACCTATAACCCTGAGG | 1591 | RNA32 |
| Y | 16565563 | AGCACACATGAATAACCCTAAGG | 1592 | X50 |
| Y | 22230617 | AAGATCCCAGAATAACTACTGG | 1593 | RNA41 |

TABLE 14

ANGPTL3 gRNA off-target site validation in human primary hepatocytes

| Chromosome | Location | Editing % | | Net Editing % |
|---|---|---|---|---|
| | | treated | control | |
| 1 | 62604219 | 61.93 | 0.39 | 61.54 |
| 1 | 2.28E+08 | 0.75 | 0.81 | −0.06 |
| 1 | 2E+08 | 0.1 | 0.03 | 0.07 |
| 1 | 59422147 | 0.32 | 0.4 | −0.08 |
| 1 | 76436411 | 0.3 | 0.26 | 0.04 |
| 1 | 19936662 | 0.26 | 0.2 | 0.06 |
| 1 | 1.8E+08 | 0.47 | 0.55 | −0.08 |
| 2 | 1.7E+08 | 0.18 | 0.1 | 0.08 |

TABLE 14-continued

ANGPTL3 gRNA off-target site validation in human primary hepatocytes

| Chromosome | Location | Editing % treated | Editing % control | Net Editing % |
|---|---|---|---|---|
| 2 | 17555591 | 0.09 | 0.12 | −0.03 |
| 2 | 87443936 | 0.27 | 0.26 | 0.01 |
| 2 | 2.26E+08 | 0.13 | 0.19 | −0.06 |
| 2 | 1.22E+08 | 0.48 | 0.62 | −0.14 |
| 2 | 1.84E+08 | 0.26 | 0.36 | −0.1 |
| 2 | 1.88E+08 | 0.26 | 0.22 | 0.04 |
| 3 | 8738135 | 0.28 | 0.23 | 0.05 |
| 3 | 539550 | 1.24 | 0.44 | 0.8 |
| 3 | 1.21E+08 | 0.26 | 0.27 | −0.01 |
| 3 | 99319950 | 0.21 | 0.22 | −0.01 |
| 4 | 1.73E+08 | 0.22 | 0.22 | 0 |
| 4 | 1.44E+08 | 0.48 | 0.54 | −0.06 |
| 4 | 51965380 | 0.09 | 0.08 | 0.01 |
| 4 | 1.01E+08 | 0.09 | 0.08 | 0.01 |
| 4 | 26200297 | 0.14 | 0.11 | 0.03 |
| 4 | 74170265 | 0.54 | 0.3 | 0.24 |
| 5 | 1.14E+08 | 0.16 | 0.13 | 0.03 |
| 5 | 1.56E+08 | 0.47 | 0.59 | −0.12 |
| 5 | 8704833 | 0 | 0 | 0 |
| 5 | 16404802 | 0.15 | 0.19 | −0.04 |
| 6 | 1.13E+08 | 0.09 | 0.11 | −0.02 |
| 6 | 45506487 | 0.3 | 0.36 | −0.06 |
| 6 | 89636030 | 0.28 | 0.3 | −0.02 |
| 6 | 18241159 | 0.08 | 0.1 | −0.02 |
| 6 | 1.05E+08 | 0.45 | 0.39 | 0.06 |
| 6 | 84651006 | 0.15 | 0.11 | 0.04 |
| 6 | 1.26E+08 | 0.17 | 0.14 | 0.03 |
| 6 | 1.34E+08 | 0.23 | 0.29 | −0.06 |
| 6 | 22811364 | 0.3 | 0.31 | −0.01 |
| 6 | 6543792 | 0.08 | 0.15 | −0.07 |
| 6 | 3993855 | 0.39 | 0.45 | −0.06 |
| 6 | 51857715 | 0.19 | 0.29 | −0.1 |
| 6 | 90026983 | 0.28 | 0.31 | −0.03 |
| 6 | 1.48E+08 | 0.15 | 0.17 | −0.02 |
| 6 | 1.46E+08 | 0.32 | 0.35 | −0.03 |
| 7 | 1.58E+08 | 0.5 | 0.45 | 0.05 |
| 7 | 1.05E+08 | 0.4 | 0.61 | −0.21 |
| 7 | 18326887 | 0.03 | 0 | 0.03 |
| 7 | 81886792 | 0.23 | 0.47 | −0.24 |
| 7 | 1.24E+08 | 0.62 | 0.44 | 0.18 |
| 7 | 1.14E+08 | 0.41 | 0 | 0.41 |
| 8 | 66947451 | 17.71 | 0.67 | 17.04 |
| 8 | 19687879 | 0.19 | 0.26 | −0.07 |
| 8 | 76479079 | 0.44 | 0.44 | 0 |
| 8 | 1.09E+08 | 0.14 | 0.23 | −0.09 |
| 8 | 88225407 | 0.44 | 0.57 | −0.13 |
| 8 | 1.4E+08 | 0.29 | 0.34 | −0.05 |
| 8 | 1.22E+08 | 0.42 | 0.57 | −0.15 |
| 9 | 89929285 | 0.15 | 0.21 | −0.06 |
| 9 | 1.01E+08 | 0.41 | 0.49 | −0.08 |
| 10 | 32570562 | 0.17 | 0.23 | −0.06 |
| 11 | 2376222 | 0.05 | 0.11 | −0.06 |
| 11 | 58705310 | 0.36 | 0.39 | −0.03 |
| 11 | 80186841 | 0.24 | 0.24 | 0 |
| 11 | 12052022 | 0.35 | 0.32 | 0.03 |
| 12 | 26607410 | 0.41 | 0.46 | −0.05 |
| 12 | 64120945 | 0.26 | 0.27 | −0.01 |
| 12 | 98856708 | 0.34 | 0.42 | −0.08 |
| 12 | 71164415 | 0.42 | 0.37 | 0.05 |
| 13 | 60126783 | 0.23 | 0.22 | 0.01 |
| 13 | 1.12E+08 | 0.59 | 0.76 | −0.17 |
| 14 | 20357994 | 2.53 | 0.43 | 2.1 |
| 14 | 66348379 | 0.21 | 0.22 | −0.01 |
| 14 | 81206628 | 0.28 | 0.28 | 0 |
| 14 | 22348176 | 0.74 | 0.68 | 0.06 |
| 14 | 76759328 | 0.07 | 0.04 | 0.03 |
| 15 | 94867496 | 0.32 | 0.42 | −0.1 |
| 15 | 60876750 | 0.3 | 0.27 | 0.03 |
| 15 | 43079813 | 100 | 99.93 | 0.07 |
| 16 | 17094952 | 7.87 | 1.57 | 6.3 |
| 16 | 52525199 | 0.83 | 0.69 | 0.14 |
| 17 | 39300993 | 0.08 | 0.11 | −0.03 |
| 18 | 21942917 | 0.48 | 0.65 | −0.17 |
| 18 | 47612935 | 0.24 | 0.3 | −0.06 |
| 19 | 37641018 | 0.4 | 0.34 | 0.06 |
| 20 | 60198378 | 0.4 | 0.35 | 0.05 |
| 21 | 45566319 | 0.26 | 0.35 | −0.09 |
| 21 | 17566032 | 0.15 | 0.18 | −0.03 |
| 21 | 17021098 | 0.19 | 0.17 | 0.02 |
| 22 | 18016369 | 0.08 | 0.21 | −0.13 |
| X | 1.07E+08 | 0.25 | 0.29 | −0.04 |
| X | 1.17E+08 | 0.24 | 0.2 | 0.04 |
| X | 21471705 | 0.42 | 0.4 | 0.02 |
| X | 73819519 | 0.25 | 0.3 | −0.05 |
| X | 6286346 | 0.58 | 0.83 | −0.25 |
| X | 1.14E+08 | 0.38 | 0.38 | 0 |

Modifications and/or truncations to either the spacer or tracr portion of the gRNA was assessed by alteration of the gRNA GA100 spacer (5'-AAGATACCTGAATAACCCTC-3' (SEQ TD NO: 15)) (Table 15). The modifications to the guide can serve to improve on-target editing efficiency and/or improve off-target editing efficiency. Additionally, four different ABE8.8 mRNAs were assessed (MA004, MA040, MA041, MA045; Table 23), in two different experiments (separated in the table below). Each of the gRNAs with an equivalent amount of in vitro transcribed ABE8.8 mRNA (1:1 ratio by weight) were co-transfected into primary human hepatocytes and primary cynomolgus hepatocytes at 5000, 2500, and 1250 ng/RNA/mL and processed as described.

TABLE 15 gRNA and/or mRNA modifications improve gRNA specificity

| gRNA | Protospacer (5'-3') | SEQ ID NO: | mRNA | Human Primary Hepatocytes—Editing % at Position 6 (Dose, Replicate #) | | | | | |
|---|---|---|---|---|---|---|---|---|---|
| | | | | 5000, rep 1 | 5000, rep 2 | 2500, rep 1 | 2500, rep 2 | 1250, rep 1 | 1250, rep 2 |
| GA441 | AAGATACCTG AATAACCCTC | 15 | MA004 | ND | 47.29 | 52.04 | 49.69 | 41.45 | 42.72 |
| GA442 | AAGATACCTG AATAACCCTC | 15 | MA004 | 35.34 | 32.48 | 35.2 | 35.78 | 31.54 | 27.9 |
| GA472 | AAGATACCTG AATAACCCTC | 15 | MA004 | 37.65 | 36.08 | 37.98 | 32.46 | 28.85 | 32.1 |

TABLE 15-continued gRNA and/or mRNA modifications improve gRNA specificity

| gRNA | Protospacer (5'-3') | SEQ ID NO: | mRNA | Human Primary Hepatocytes—Editing % at Position 6 (Dose, Replicate #) | | | | | |
|---|---|---|---|---|---|---|---|---|---|
| | | | | 5000, rep 1 | 5000, rep 2 | 2500, rep 1 | 2500, rep 2 | 1250, rep 1 | 1250, rep 2 |
| GA473 | AAGATACCTG AATAACCCTC | 15 | MA004 | 37.9 | 31.23 | 37.55 | 35.45 | 28.07 | 26.92 |
| GA474 | AAGATACCTG AATAACCCTC | 15 | MA004 | 30.59 | 39.55 | 37.46 | 37.26 | 28.79 | 25.37 |
| GA475 | AGATACCTGA ATAACCCTC | 248 | MA004 | 36.82 | 37.79 | 37.96 | 40.49 | 28.11 | 28.81 |
| GA476 | GATACCTGAAT AACCCTC | 249 | MA004 | 37.2 | 37.7 | 42.27 | 40.86 | 31.97 | 31.48 |
| GA477 | ATACCTGAATA ACCCTC | 250 | MA004 | 25.59 | 24.9 | 27.3 | 25.25 | 19.23 | 19.19 |
| GA441 | AAGATACCTG AATAACCCTC | 15 | MA040 | 43.09 | 45.18 | 29.68 | 47.56 | 41.53 | 35.98 |
| GA442 | AAGATACCTG AATAACCCTC | 15 | MA040 | 41.76 | 43.74 | 41.43 | 41.19 | 31.04 | 32.85 |
| GA472 | AAGATACCTG AATAACCCTC | 15 | MA040 | 41.15 | 42.31 | 40.66 | 40.5 | 31.38 | 28.23 |
| GA473 | AAGATACCTG AATAACCCTC | 15 | MA040 | 39.8 | 39 | 40.85 | 34.58 | 29.19 | 28.19 |
| GA474 | AAGATACCTG AATAACCCTC | 15 | MA040 | 38.99 | 33.48 | 30.43 | 34.63 | 24.83 | 22.76 |
| GA475 | AGATACCTGA ATAACCCTC | 248 | MA040 | 37.64 | 39.98 | 37.03 | 39.31 | 28.67 | 26.83 |
| GA476 | GATACCTGAAT AACCCTC | 249 | MA040 | 41.08 | 39.14 | 37.69 | 38.01 | 28.8 | 27.26 |
| GA477 | ATACCTGAATA ACCCTC | 250 | MA040 | 20.51 | 19.43 | 22.64 | 22.01 | 15.69 | 16.61 |
| GA441 | AAGATACCTG AATAACCCTC | 15 | MA041 | 28.97 | 20.87 | 31.35 | 37.98 | 27.9 | 27.48 |
| GA442 | AAGATACCTG AATAACCCTC | 15 | MA041 | 26.39 | 25.73 | 29.01 | 27.38 | 20.18 | 20.53 |
| GA472 | AAGATACCTG AATAACCCTC | 15 | MA041 | 27.32 | 29.91 | 28.54 | 28.29 | 23.4 | 23.15 |
| GA473 | AAGATACCTG AATAACCCTC | 15 | MA041 | 19.75 | 19.89 | 19.6 | 17.62 | 14.97 | 14.04 |
| GA474 | AAGATACCTG AATAACCCTC | 15 | MA041 | 22.56 | 20.87 | 18.86 | 17.38 | 15.4 | 14.14 |
| GA475 | AGATACCTGA ATAACCCTC | 248 | MA041 | 31.47 | 29.18 | 27.34 | 23.98 | 17.67 | 18.89 |
| GA476 | GATACCTGAAT AACCCTC | 249 | MA041 | 31.01 | 33.84 | 29.37 | 28.62 | 19.77 | 21.75 |
| GA477 | ATACCTGAATA ACCCTC | 250 | MA041 | 3.7 | 2.53 | 3.92 | 3.47 | 2.96 | 3.24 |
| GA441 | AAGATACCTG AATAACCCTC | 15 | MA004 | 33.26 | 34.23 | 42 | 36.89 | 34.57 | 31.5 |
| GA442 | AAGATACCTG AATAACCCTC | 15 | MA004 | 27.1 | 35.52 | 36.03 | 32.59 | 28.21 | 32.14 |

TABLE 15-continued gRNA and/or mRNA modifications improve gRNA specificity

Human Primary Hepatocytes—Editing % at Position 6 (Dose, Replicate #)

| gRNA | Protospacer (5'-3') | SEQ ID NO: | mRNA | 5000, rep 1 | 5000, rep 2 | 2500, rep 1 | 2500, rep 2 | 1250, rep 1 | 1250, rep 2 |
|---|---|---|---|---|---|---|---|---|---|
| GA472 | AAGATACCTGAATAACCCTC | 15 | MA004 | 32.58 | 22.71 | 27.15 | 38.51 | 29.44 | 32.3 |
| GA473 | AAGATACCTGAATAACCCTC | 15 | MA004 | 28.63 | 27.84 | 18.2 | 36.76 | 31.84 | 29.58 |
| GA474 | AAGATACCTGAATAACCCTC | 15 | MA004 | 25.26 | 22.74 | 26.59 | 35.61 | 28.96 | 26.24 |
| GA475 | AGATACCTGAATAACCCTC | 248 | MA004 | 28.61 | 34.79 | 30.52 | 35.29 | 29.14 | 30.03 |
| GA476 | GATACCTGAATAACCCTC | 249 | MA004 | 31.45 | 27.75 | 31.88 | 32.11 | 26.99 | 30.15 |
| GA477 | ATACCTGAATAACCCTC | 250 | MA004 | 15.07 | 13.4 | 15.01 | 18.73 | 16.78 | 16.96 |
| GA441 | AAGATACCTGAATAACCCTC | 15 | MA045 | 20.49 | 21.6 | 26.32 | 26.13 | 24.37 | 25.48 |
| GA442 | AAGATACCTGAATAACCCTC | 15 | MA045 | 25.65 | 17.51 | 25.36 | 18.73 | 18.54 | 20.34 |
| GA472 | AAGATACCTGAATAACCCTC | 15 | MA045 | 20.87 | 15.13 | 19.67 | 19.28 | 19.07 | ND |
| GA473 | AAGATACCTGAATAACCCTC | 15 | MA045 | 14.84 | 14.05 | 20.14 | 15.95 | 15.95 | 16.71 |
| GA474 | AAGATACCTGAATAACCCTC | 15 | MA045 | 15.81 | 16.04 | 17.08 | 20.15 | 15.02 | 14.33 |
| GA475 | AGATACCTGAATAACCCTC | 248 | MA045 | 24.33 | 31.08 | 25.52 | 28.55 | 20.61 | 21.1 |
| GA476 | GATACCTGAATAACCCTC | 249 | MA045 | 25.43 | 24.26 | 23.45 | 26.05 | 21.47 | 23.35 |
| GA477 | ATACCTGAATAACCCTC | 250 | MA045 | 5.06 | 2.84 | 3.07 | 4.65 | 3.75 | 3.01 |

Off-target analysis for altered gRNA/mRNA combinations at the highest dose of 5,000 ng/RNA/mL was performed for two sites previously identified that showed off-target editing (Table 16). The calculated editing percentage across the protospacer was totaled, and the negative control editing 00 was subtracted. This data shows that modifications to the guide and/or to the ABE mRNA improve off-target editing efficiency.

TABLE 16

Modifications to the guide and/or to the ABE mRNA improve off-target editing efficiency.

| gRNA | mRNA | Human Primary Hepatocytes—SUM total editing % (all positions) minus control, AVG of ~2 replicates | |
|---|---|---|---|
| | | OT Site A | OT Site B |
| GA441 | MA004 | 9.785 | 1.605 |
| | MA040 | 7.17 | 0.85 |
| | MA041 | −0.1 | −0.27 |
| GA442 | MA004 | 7.65 | 0.77 |
| | MA040 | 6.97 | 0.64 |
| | MA041 | −0.005 | −0.17 |

TABLE 16-continued

Modifications to the guide and/or to the ABE mRNA improve off-target editing efficiency.

| gRNA | mRNA | OT Site A | OT Site B |
|---|---|---|---|
| GA472 | MA004 | 0.36 | −0.13 |
| | MA040 | 0.78 | −0.185 |
| | MA041 | −0.035 | −0.205 |
| GA473 | MA004 | −0.145 | −0.135 |
| | MA040 | −0.1 | −0.215 |
| | MA041 | −0.085 | −0.19 |
| GA474 | MA004 | 1.075 | 0.03 |
| | MA040 | 1.545 | 0.39 |
| | MA041 | −0.095 | −0.14 |
| GA475 | MA004 | 2.79 | 0.39 |
| | MA040 | 1.68 | ND |
| | MA041 | −0.13 | −0.205 |
| GA476 | MA004 | 0.48 | 0.385 |
| | MA040 | 0.785 | 0.295 |
| | MA041 | −0.17 | ND |
| GA477 | MA004 | −0.13 | −0.215 |
| | MA040 | −0.48 | −0.23 |
| | MA041 | −0.225 | −0.14 |

TABLE 16-continued

Modifications to the guide and/or to the ABE mRNA improve off-target editing efficiency.

| | | Human Primary Hepatocytes—SUM total editing % (all positions) AVG of ~2 replicates | |
|---|---|---|---|
| GA441 | MA004 | 6.575 | 2.345 |
| | MA045 | 1.36 | 0.865 |
| GA442 | MA004 | 7.315 | 1.75 |
| | MA045 | 1.355 | 0.895 |
| GA472 | MA004 | 2.195 | 1.005 |
| | MA045 | 1.19 | 0.87 |
| GA473 | MA004 | 1.47 | 1.025 |
| | MA045 | 1.495 | 0.98 |
| GA474 | MA004 | 2.145 | 1.055 |
| | MA045 | 1.405 | 0.9 |
| GA475 | MA004 | 3.67 | 1.825 |
| | MA045 | 1.39 | 0.955 |
| GA476 | MA004 | 1.775 | 1.675 |
| | MA045 | 1.505 | 0.84 |
| GA477 | MA004 | 1.31 | 0.975 |
| | MA045 | 1.135 | 0.83 |

Figure 15:
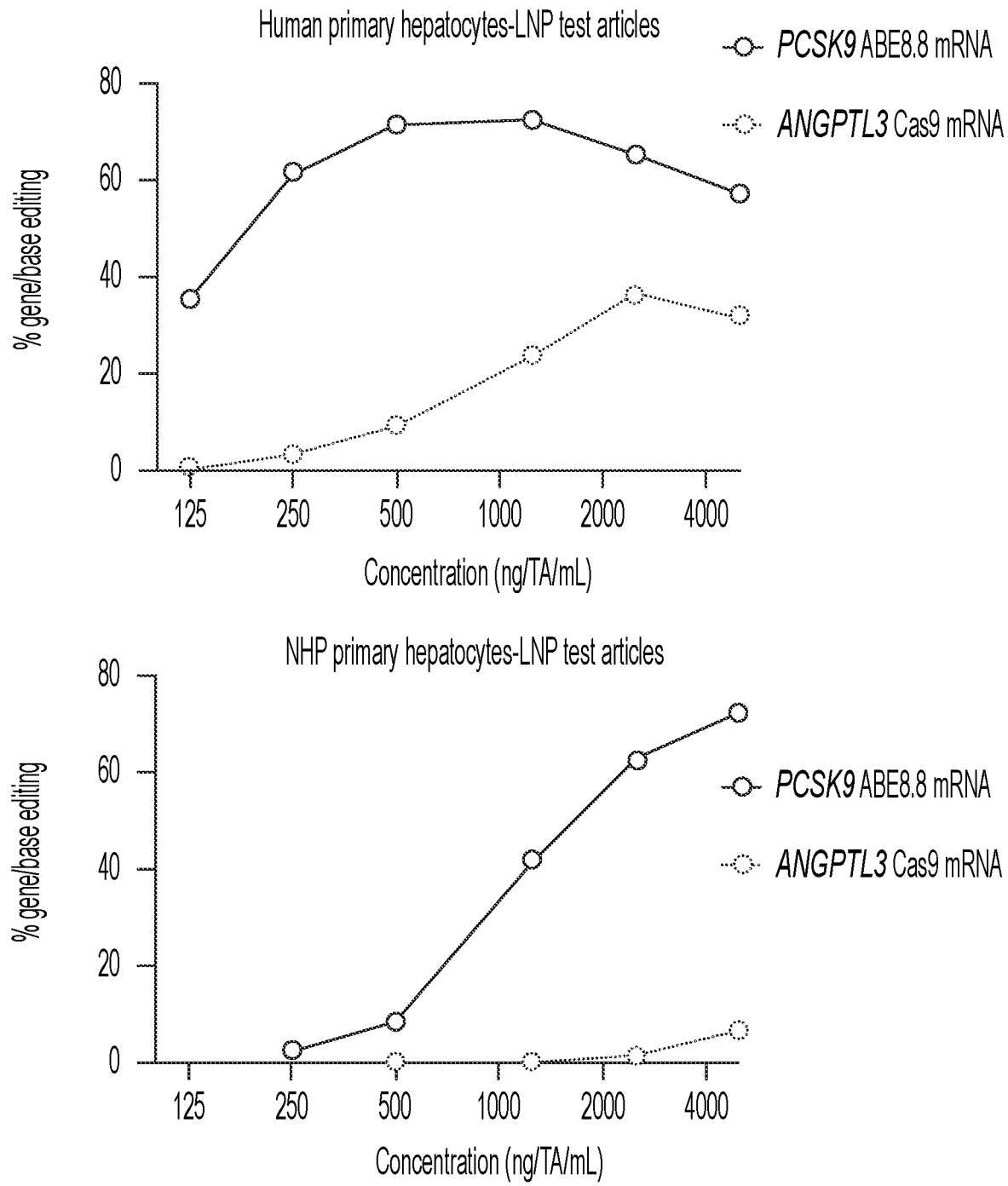
FIG. 15 shows PCSK9 and ANGPTL3 base editing with lipid nanoparticles (LNPs) formulated with an embodiment of base editor system, ABE mRNA and a guide RNA, in primary human hepatocytes and primary non-human primates (NHP) hepatocytes. The human-specific ANGPTL3 guide RNA showed low editing efficiency in NHP hepatocytes within the concentration evaluated, whereas the PCSK9 guide RNA cross-reactive to both human and NHP showed high editing efficiency in both cell lines.

Lipid nanoparticles containing ABE8.8 mRNA and a gRNA matching the human/cynomolgus 5'-CCCGCACCTTGGCGCAGCGG-3' (SEQ ID NO: 13) sequence (GA066) that targets the splice donor at the 5' end of PCSK9 intron 1 were formulated at a 1:1 ratio by weight. The LNPs were administered to primary human hepatocytes and primary cynomolgus hepatocytes, using various dilutions to assess for editing activity at different concentrations of test article. LNP containing Cas9 mRNA and a gRNA matching a protospacer sequence in another gene, ANGPTL3, as a positive control was used for these experiments. This Cas9 mRNA/gRNA combination were chosen because it had been previously observed to produce high levels of genome-editing activity in primary human hepatocytes, primary cynomolgus hepatocytes, and cynomolgus liver in vivo. It was observed the ABE8.8/GA066 LNP substantially outperformed the control LNP with respect to editing, displaying much higher potency in both human and cynomolgus hepatocytes (FIG. 15).

Example 5. Pcsk9 Gene Editing in Mice

Figure 16:
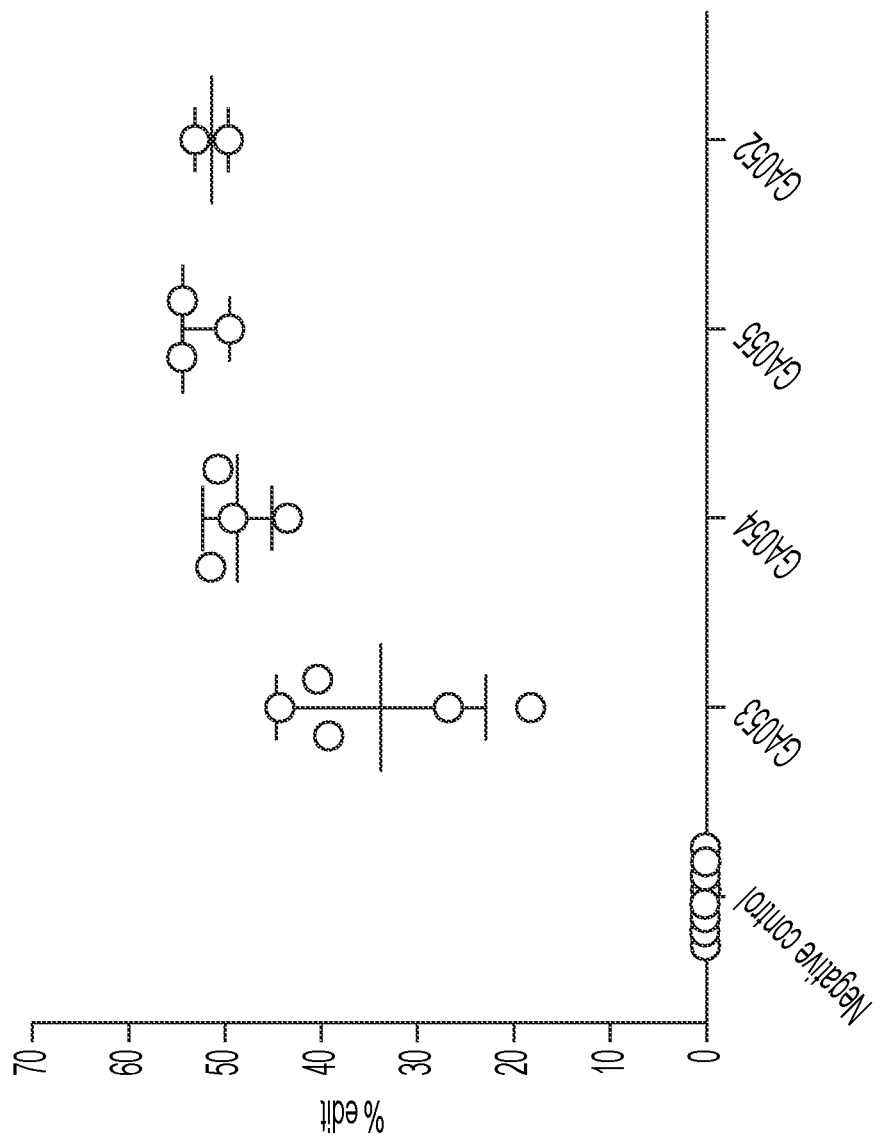
FIG. 16, GA054 (tracr1) and GA055 (tracr2) and (2) NHP.

LNPs containing SpCas9 mRNA and mouse Pcsk9-targeting gRNA with different tracr designs (GA052, GA053, GA054, and GA055) at a 1:1 weight ratio were formulated. Wild-type C57BL/6 mice were dosed with 2 mg/kg of the LNP test article. Seven days after dosing, the mice were euthanized and genomic DNA was harvested from mouse liver, and then assessed for editing of the target site with next-generation sequencing. GA052, GA054, and GA055 all outperformed GA053 that had a previously disclosed tracr design (FIG. 16).

Example 6. Pcsk9 Base Editing in Mice

Figure 17:
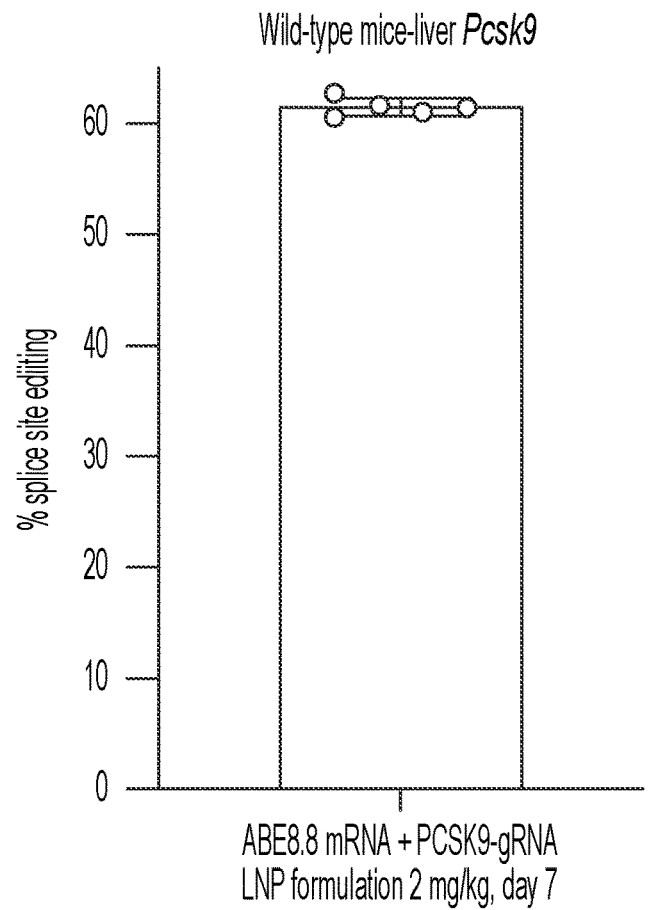
FIG. 17 shows base editing of PCSK9 in mice (n=5) via LNPs with an embodiment of base editor system, ABE mRNA MA004 and PCSK9 guide RNA GA256 (targeting mouse intron 1 splice donor). Wild-type C57BL/6 mice were dosed with 2 mg/kg total RNA of the LNP test article. Seven days after dosing, the mice were euthanized and genomic DNA was harvested from mouse liver, and then assessed for base editing of the target site with next-generation sequencing.

LNPs containing ABE8.8 mRNA and a mouse Pcsk9-targeting gRNA at a 1:1 weight ratio were formulated. This gRNA matches the 5'-CCCATACCTTGGAGCAACGG-3' (SEQ ID NO: 69) protospacer sequence, which is the mouse ortholog of the human 5'-CCCGCACCTTGGCGCAGCGG-3' (SEQ ID NO: 13) sequence (matched by GA066, GA095, GA096, GA097 and GA346) that targets the splice donor at the 5' end of PCSK9 intron 1. Wild-type C57BL/6 mice were dosed with 2 mg/kg of the LNP test article via the lateral tail vein or retro-orbital in a total volume of 10 ml/kg. Seven days after dosing, the mice were euthanized and genomic DNA was harvested from mouse liver, and then assessed for base editing of the target splice site with next-generation sequencing. Approximately 60% editing of the target splice site was observed (mouse Pcsk9 intron 1 splice donor) (FIG. 17), providing a preclinical proof of concept of a base-editing therapy knocking down PCSK9 in the liver in vivo.

Figure 18:
FIG. 18 depicts editing of the Pcsk9 exon 1 splice-donor adenine base in wild-type mouse liver, assessed 1 week following treatment with different doses of same LNP formulation with ABE8.8 mRNA MA004 and Pcsk9 gRNA GA256 (n=4 to 5 mice per dosing group, bar indicates mean editing in group).

In a subsequent study, LNPs containing ABE8.8 mRNA and a mouse Pcsk9-targeting gRNA at a 1:1 weight ratio were formulated, and dosed in wild-type C57BL/6 mice at doses ranging from 0-2.0 mg total RNA/kg. The low dose of 0.05 mg RNA/kg showed high editing (>45%), while saturation of base editing occurred around 0.25 mg RNA/kg dose (FIG. 18).

Figure 19:
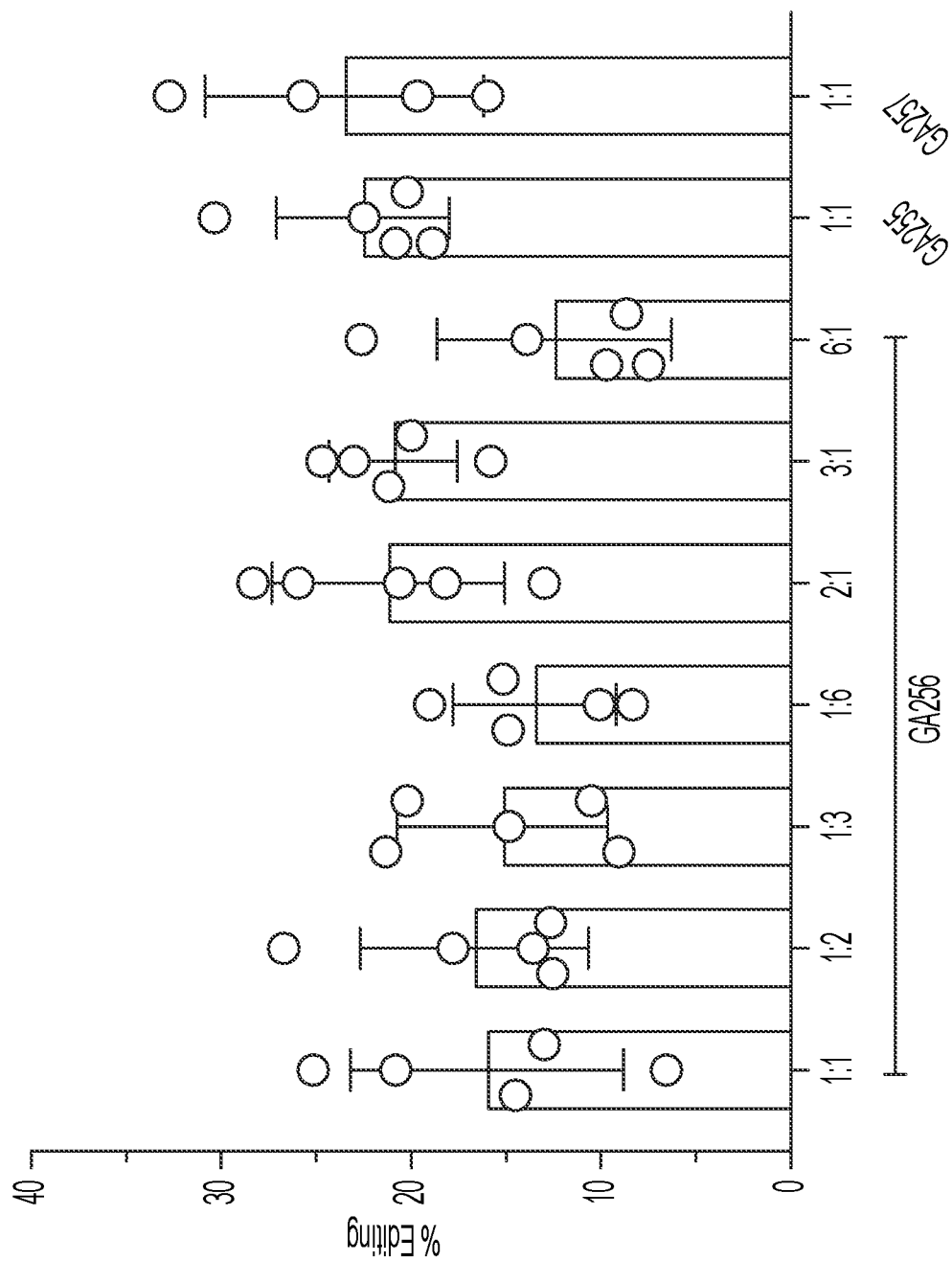
FIG. 19 depicts editing of the Pcsk9 exon 1 splice-donor adenine base in wild-type mouse liver, after dosed with LNPs at 0.05 mg/kg total RNA dose containing different ratios of gRNA GA256 and mRNA MA002. Additional guides GA255 and GA257 with different chemical modifications were also assessed for base editing efficiency, at mRNA to gRNA 1:1 wt ratio.

In an additional study, LNPs containing ABE8.8 mRNA and a mouse Pcsk9-targeting gRNA were formulated at different weight ratios of mRNA and gRNA ranging from 1:1-1:6 and 2:1-6:1. This gRNA matches the 5'-CCCATACCTTGGAGCAACGG-3' (SEQ ID NO: 69) protospacer sequence, which is the mouse ortholog of the human 5'-CCCGCACCTTGGCGCAGCGG-3' (SEQ ID NO: 13) sequence (matched by GA066, GA095, GA096, GA097 and GA346) that targets the splice donor at the 5' end of PCSK9 intron 1. Wild-type mice were dosed with the LNP at 0.05 mg/kg total RNA dose. Additionally, two individual LNPs constituted with the same mRNA and two guides, GA255 and GA257, which matches the 5'-CCCATACCTTGGAGCAACGG-3' (SEQ ID NO: 69) protospacer sequence but has modifications to the tracr to improve stability, were also injected into mice. Seven days after dosing, the mice were euthanized and genomic DNA was harvested from mouse liver, and then assessed for base editing of the target splice site with next-generation sequencing (FIG. 19). Base editing was comparable between many of the ratios, with 1:6 and 6:1 (gRNA:mRNA) performing the poorest. The guides with modifications to the tracr had increased editing efficiency.

Example 7. Angptl3 Base Editing in Mice

Figure 20:
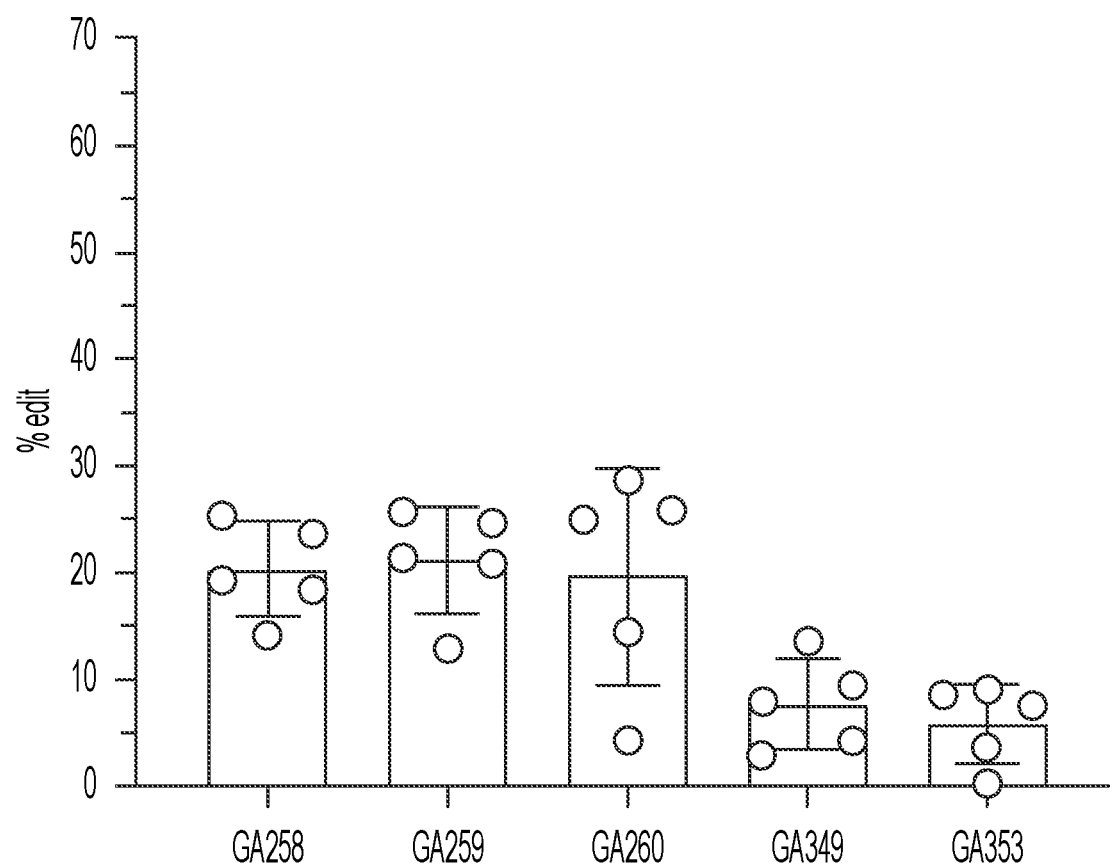
FIG. 20 shows the results from dosing LNPs containing ABE8.8 mRNA and mouse Angptl3-targeting gRNAs (GA258, GA259, GA260, GA349, GA353) at 0.05 mg/kg total RNA dose at a 1:1 weight ratio into mice. GA258, GA259 and GA260 contain three different structure-guided tracr design. GA349 and GA353 tracr designs were from published literature (Cell Reports, 2018 22, 2227-2235). The mice were later euthanized and genomic DNA was harvested from mouse liver, and then assessed for base editing of the target splice site with next-generation sequencing.

LNPs containing ABE8.8 mRNA and mouse Angptl3-targeting gRNAs (GA258, GA259, GA260, GA349, GA353) at a 1:1 weight ratio were formulated. Wild-type C57BL/6 mice were dosed with LNP test article at 0.05 mg/kg total RNA dose. The mice were later euthanized and genomic DNA was harvested from mouse liver, and then assessed for base editing of the target splice site with next-generation sequencing (FIG. 20).

In Vivo Evaluation in Non-Human Primates (NHP)

Example 8. Evaluation of PCSK9 ABE

Figure 21:
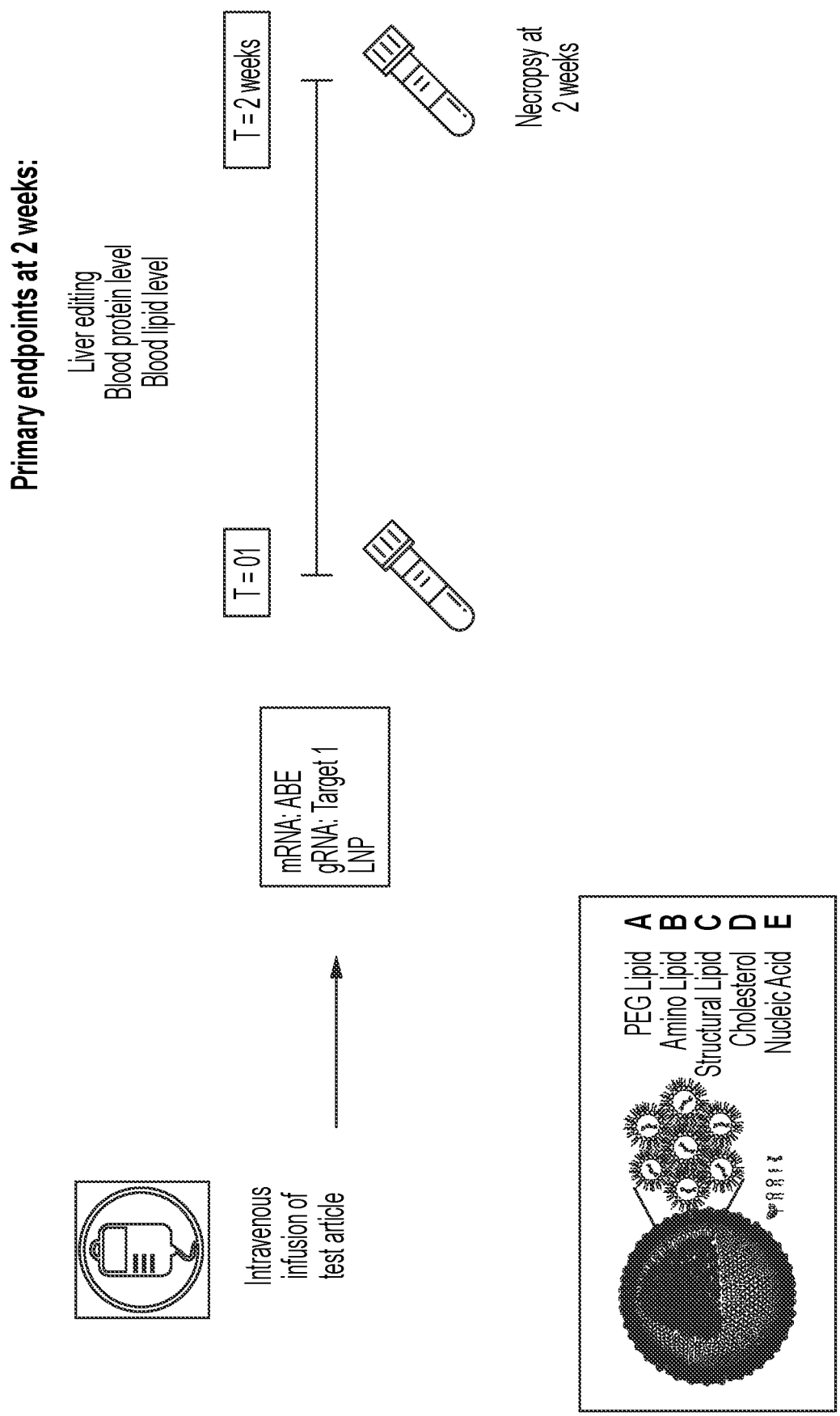
FIG. 21 is a schematic showing the general dosing strategy for introducing adenine base editing of a target gene in NHP via LNPs formulated with an embodiment of base editor system, ABE mRNA and a guide RNA, and subsequent analysis after 2 weeks.

First, a 2-week study was performed to evaluate editing of the PCSK9 gene in cynomolgus monkeys using specific gRNA and base editor nuclease ABE 8.8 through administration of LNPs (FIG. 21). The ABE8.8/GA066 LNP was administered to cynomolgus monkeys via intravenous infusion at two doses, 3 mg/kg (n=3 animals) and 1 mg/kg (n=2 animals) with the intent of producing high-level base editing of PCSK9 gene in the liver. Two weeks after administration of test article, blood samples were collected for clinical chemistry assays and PCSK9 ELISA assay, and the animals underwent necropsy for collection of liver samples, 2 samples each from each of the 4 lobes of the liver (8 in total from each animal).

Figure 22:
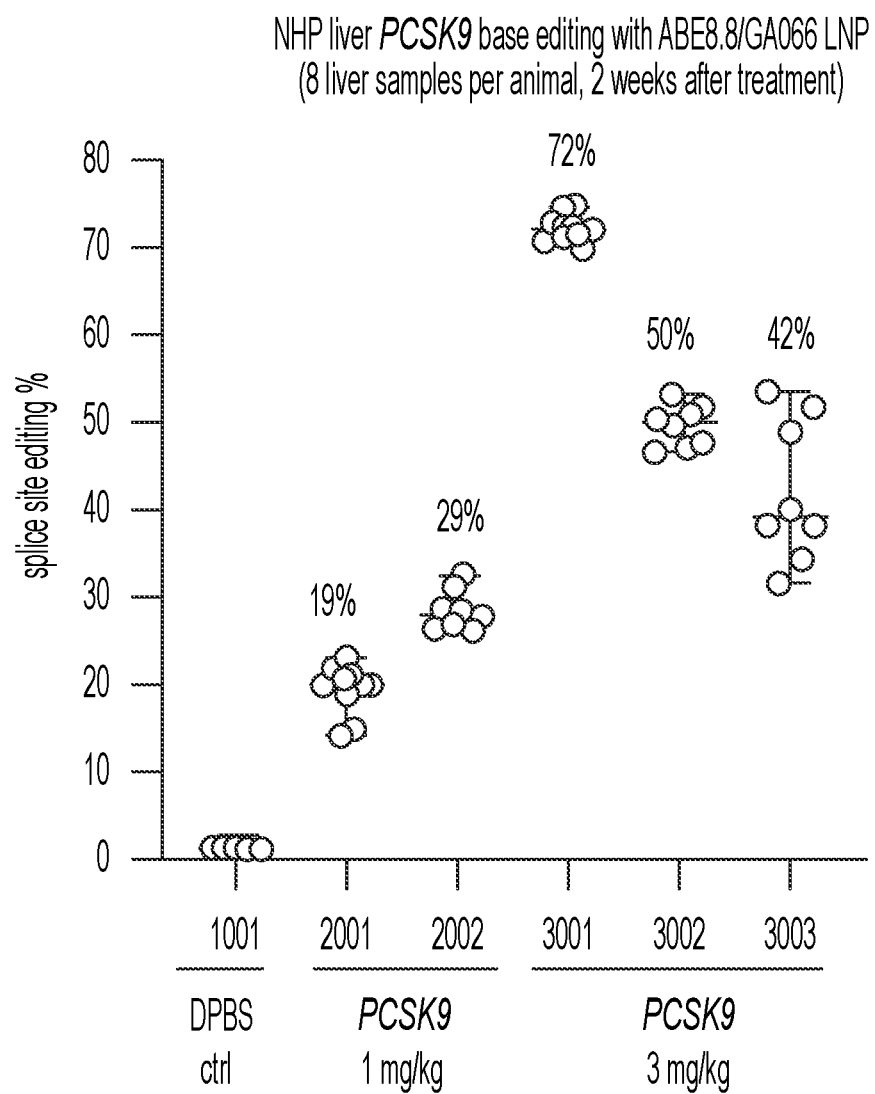
FIG. 22 shows that administration of LNPs formulated with an embodiment of base editor system, ABE mRNA MA002 and PCSK9 guide RNA GA066, at 1 mg/kg and 3 mg/kg total RNA dose to cynomolgus monkeys via intravenous infusion, induced adenine base editing at the PCSK9 target splice site in the liver of cynomolgus monkeys.
Figure 23:
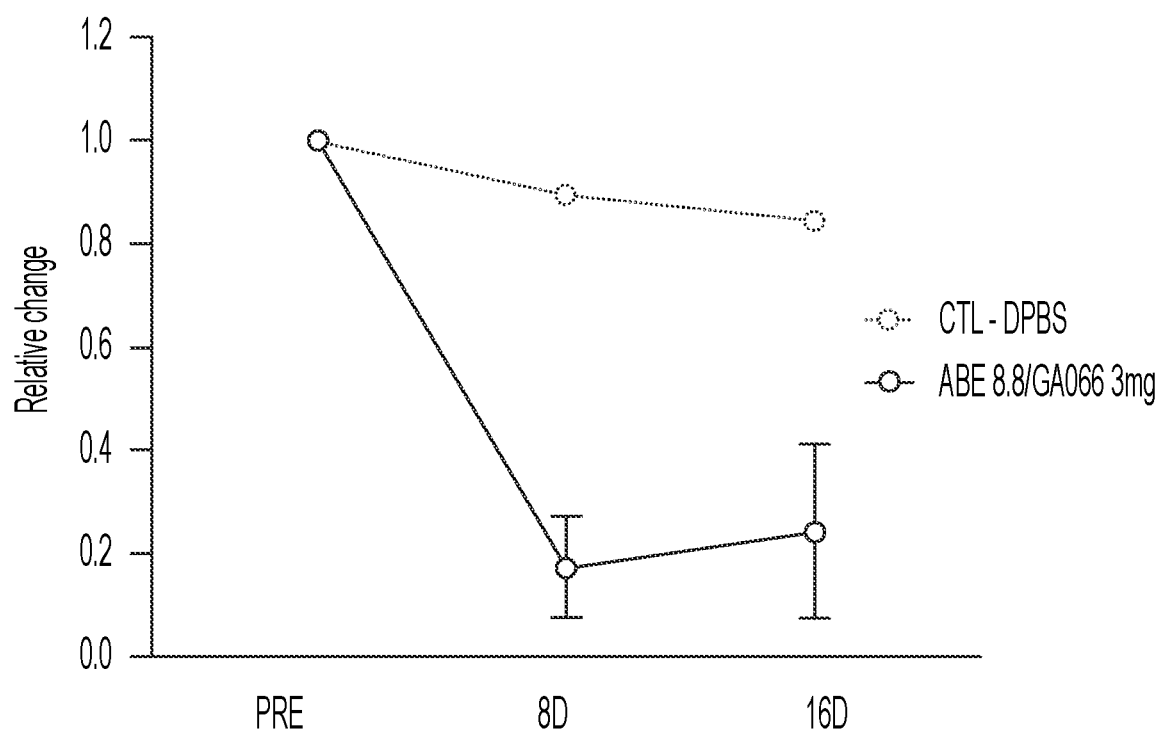
FIG. 23 shows that administration of LNPs formulated with an embodiment of base editor system, ABE mRNA MA004 and PCSK9 guide RNA GA066, to cynomolgus monkeys via intravenous infusion resulted in reduction in the blood PCSK9 protein level compared to pre-dosing levels at 2 weeks after dosing.
Figure 24:
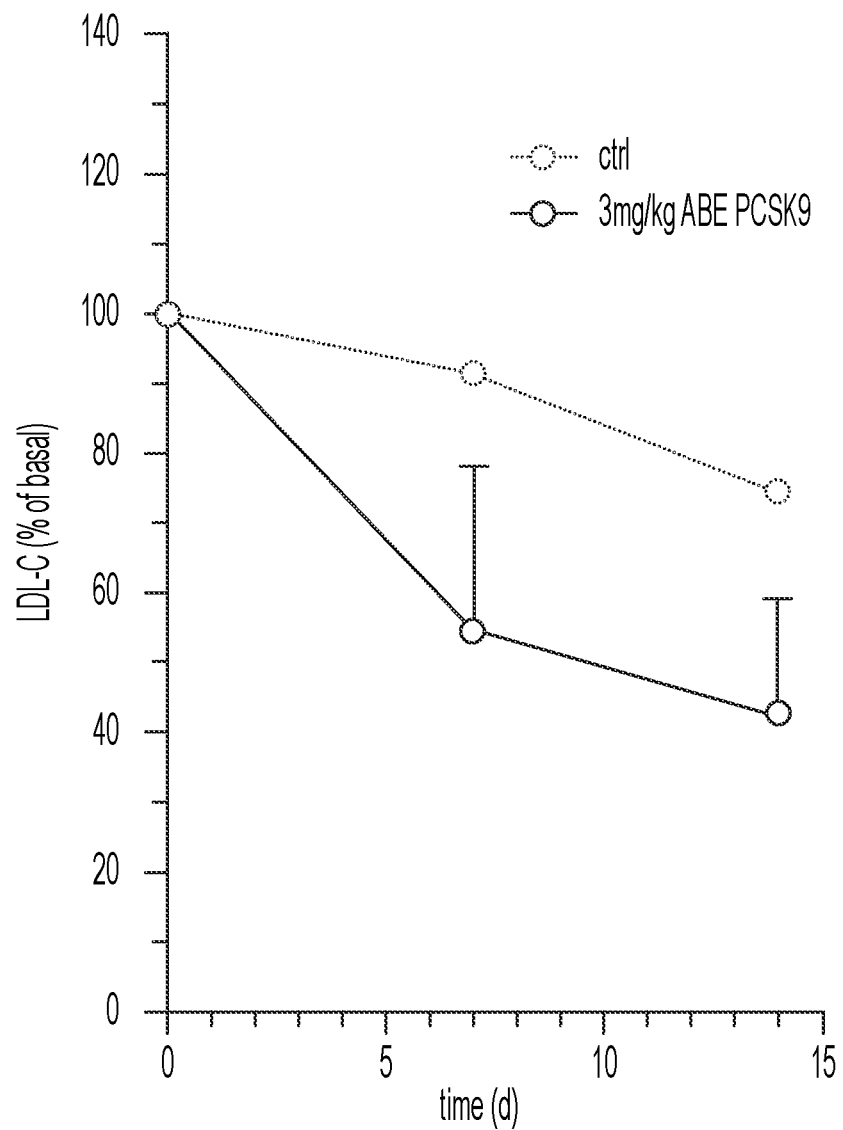
FIG. 24 shows that administration of LNPs at 3 mg/kg formulated with an embodiment of base editor system, ABE mRNA MA002 and PCSK9 guide RNA GA066, to cynomolgus monkeys via intravenous infusion resulted in reduction of the blood low-density lipoprotein cholesterol (LDL-C) level at 1 and 2 weeks after dosing compared to pre-dosing levels.

Editing analysis of the liver specimens was performed by next generation sequencing. At the 3 mg/kg dose, a mean of 55% editing of the adenine base at the target splice site in the liver samples was observed; at the 1 mg/kg dose, a mean of 24% editing of the adenine base at the target splice site in the liver samples was observed (FIG. 22). For PCSK9 ELISA analysis, blood samples were collected from the animals on days D-10, D-7 and D-5 pre-dose (average shown) as well as on D8 and D15 post-dose. At 2 weeks after dosing there was a mean 76% reduction in the blood PCSK9 protein level compared to pre-dosing levels in the 3 mg/kg group (FIG. 23), and a mean 32% reduction in the blood PCSK9 protein level in the 1 mg/kg group (Table 17). Low density lipoprotein cholesterol (LDL-C) was determined in serum samples taken pre-dose and on D8 and D15 using a standard clinical analyzer (Table 18). There was a mean 57% reduction in the blood low-density lipoprotein cholesterol (LDL-C) level in the 3 mg/kg group (FIG. 24), and a mean 25% reduction in the blood LDL-C level in the 1 mg/kg group.

TABLE 17

Circulating PCSK9 protein levels decrease after PCSK9 gRNA/ABE editing

| PCSK9 Group | Dose (total RNA, mg/kg) | Animal ID | Concentration (ng/ml) Basal | D8 | D15 | Reduction from basal on D15 (%) |
|---|---|---|---|---|---|---|
| 1 | 0 | 1001 | 432 | 387 | 366 | 15 |
| 2 | 1 | 2001 | 324 | 285 | 227 | 30 |
| 2 | 1 | 2002 | 144 | 116 | 95 | 34 |
| 3 | 3 | 3001 | 254 | 16 | 28 | 89 |
| 3 | 3 | 3002 | 170 | 34 | 31 | 82 |
| 3 | 3 | 3003 | 253 | 65 | 109 | 57 |

TABLE 18

LDL-C reduction after editing of the PCSK9 gene

| Group | Dose (total RNA, mg/kg) | Animal ID | LDL-C concentration (mg/dl) Basal | D8 | D15 | Reduction from basal on D15 (%) |
|---|---|---|---|---|---|---|
| 1 | 0 | 1001 | 76.7 | 70 | 57 | 26 |
| 2 | 1 | 2001 | 72.3 | 55 | 54 | 25 |
| 2 | 1 | 2002 | 69.0 | 53 | 52 | 25 |
| 3 | 3 | 3001 | 57.0 | 23 | 17 | 70 |
| 3 | 3 | 3002 | 60.0 | 25 | 22 | 63 |
| 3 | 3 | 3003 | 107.7 | 88 | 66 | 39 |

Figure 25B:
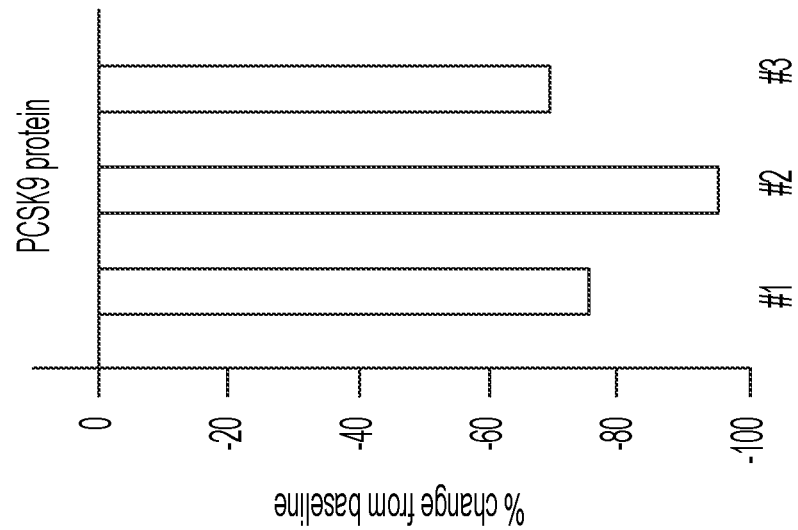
FIGS. 25A-25C show short-term adenine base editing of PCSK9 in non-human primates.
Figure 25A:
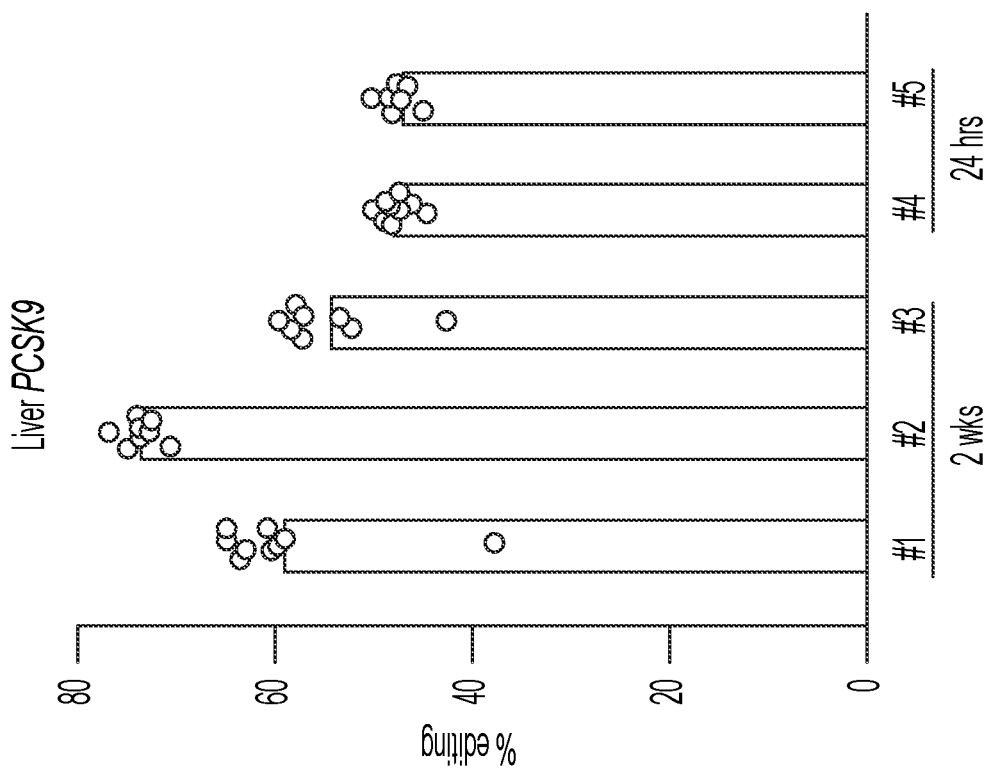
Figure 25C:
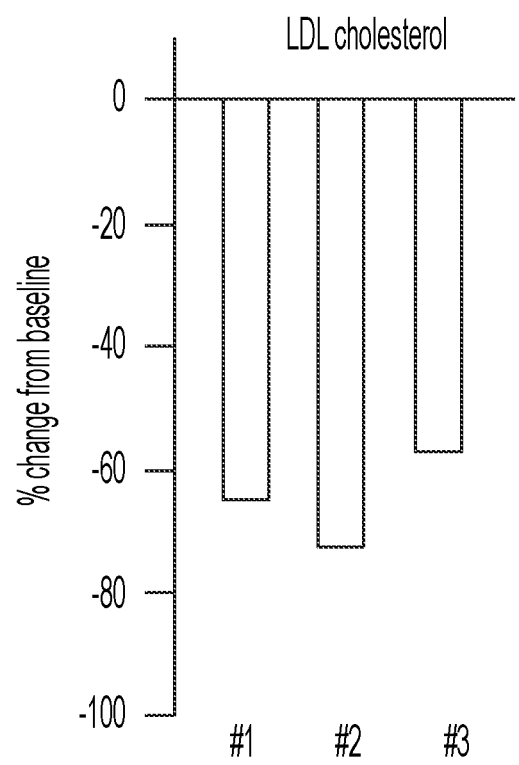

In a subsequent experiment, LNPs were delivered in monkeys via intravenous infusion at a 1.0 mg/kg dose. For three monkeys that underwent necropsy at 2 weeks after LNP infusion, there was a mean 63% base editing frequency of the PCSK9 splice site adenine in the liver, with no bystander base editing observed elsewhere in the protospacer (FIG. 25); there was a mean indel frequency of 0.5%. The editing was accompanied by a mean 81% reduction in blood PCSK9 levels and a mean 65% reduction in blood LDL-C levels. For two monkeys that underwent necropsy at 24 hours after LNP infusion, there was a mean 48% editing frequency.

Figure 26A:
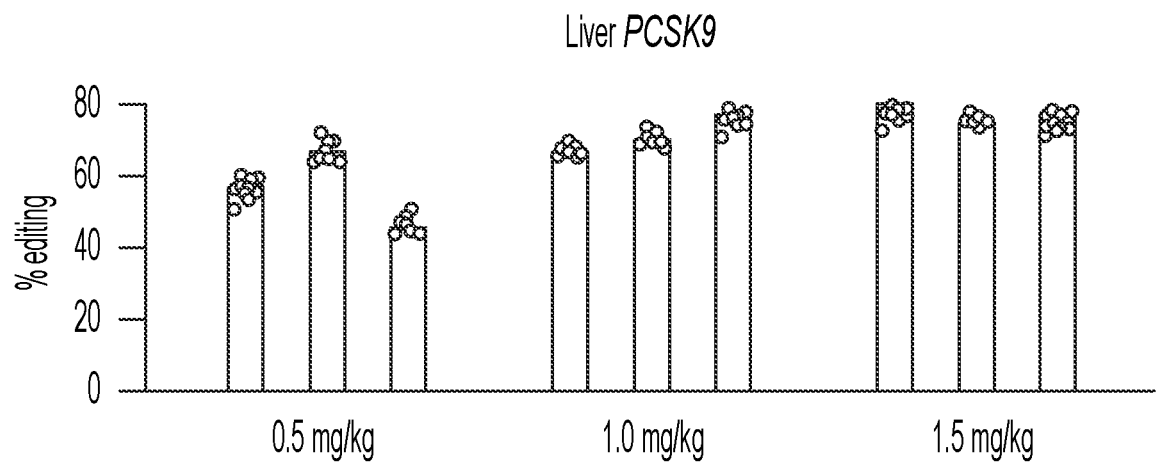
FIGS. 26A-26C shows adenine base editing of PCSK9 in non-human primates.
Figure 26B:
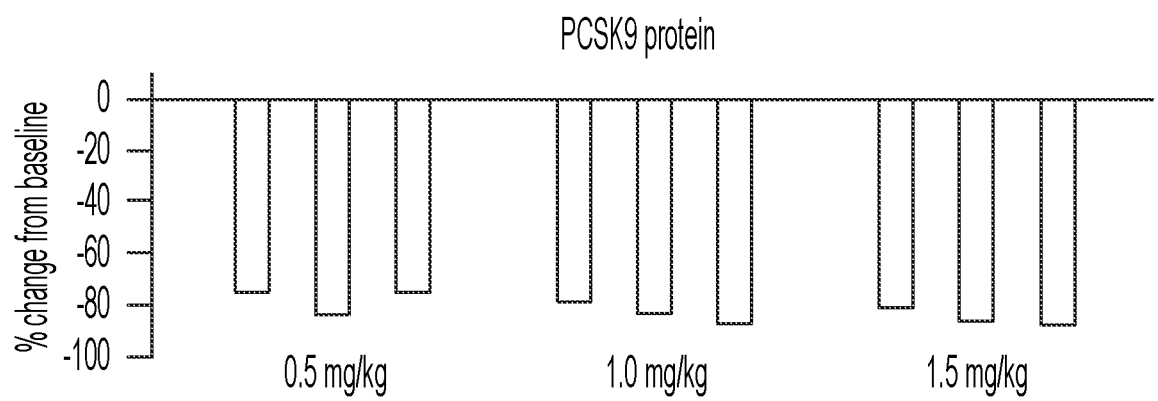
Figure 26C:
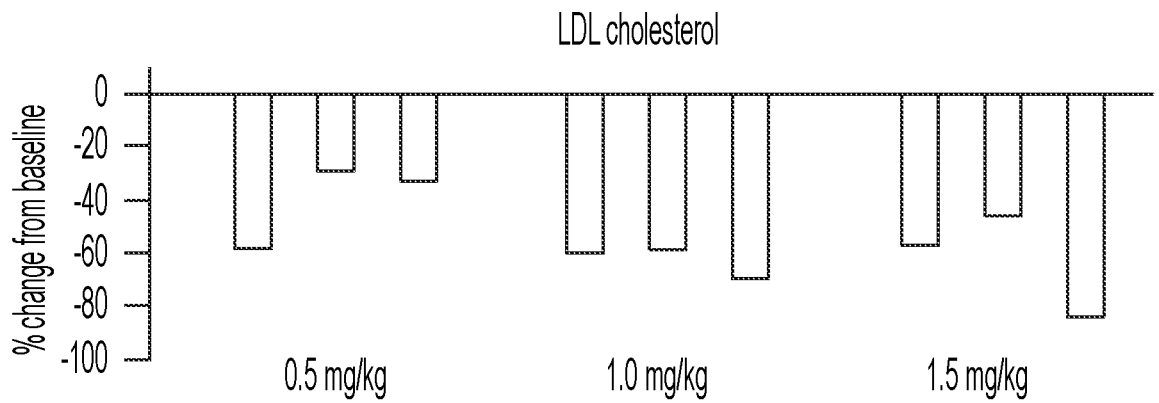

In a subsequent short-term dose-response study (0.5, 1.0, and 1.5 mg/kg doses, three monkeys each, with necropsy at 2 weeks), all doses achieved >50% mean base editing rates; PCSK9 editing and reductions in PCSK9 protein and LDL-C appeared to saturate at doses ≥1.0 mg/kg (FIG. 26).

In these studies we assessed liver function tests and in some groups noted moderate rises in AST and ALT that largely resolved by the end of the first week and entirely resolved by 2 weeks after LNP infusion, with no adverse health events observed in any of the animals. In assaying base editing in a wide variety of tissues, we found that the liver was the predominant site of editing, with much lower editing observed in the spleen and adrenal glands and minimal editing observed elsewhere (FIG. 27).

TABLE 25

Figure 27:
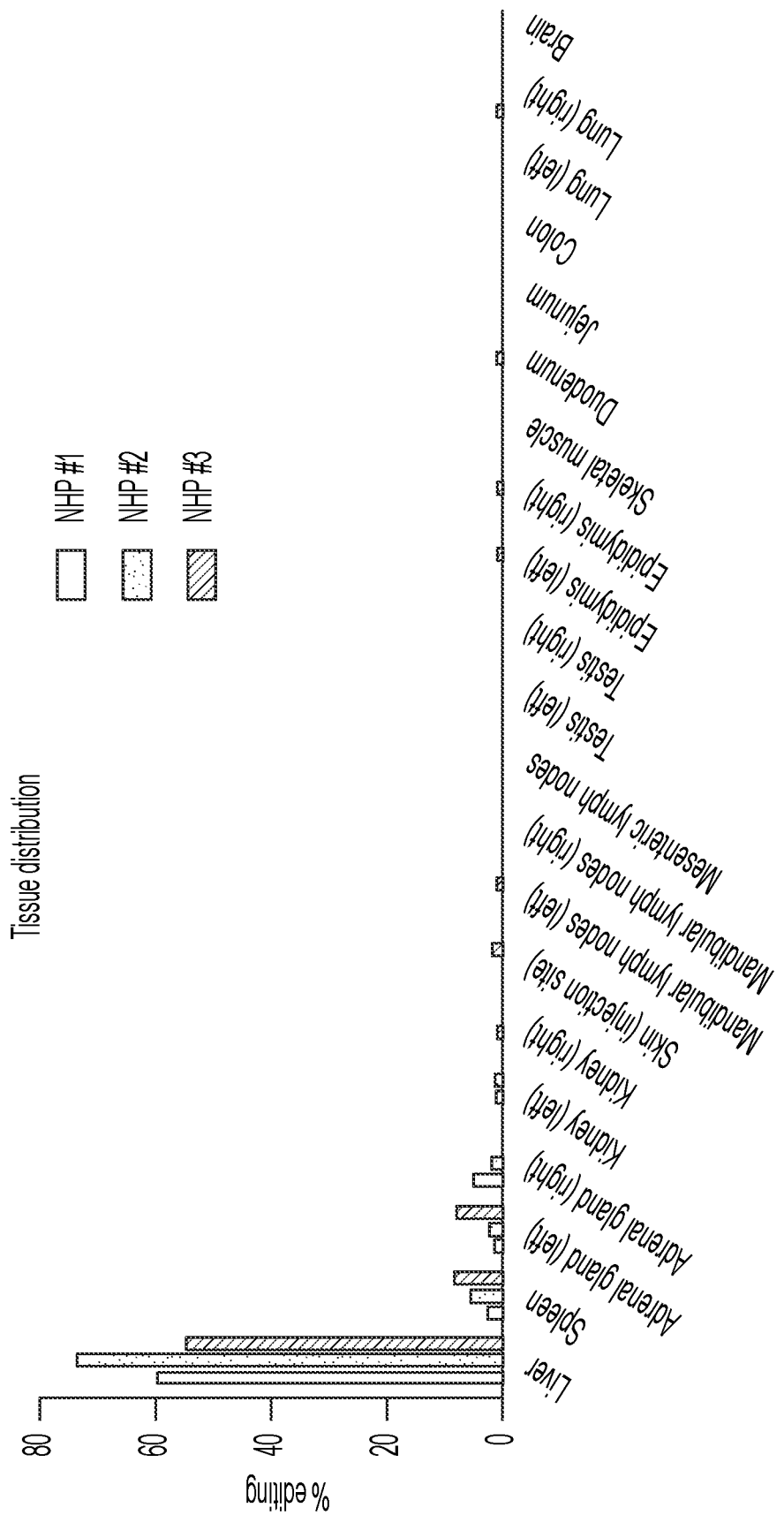
FIG. 27 depicts tissue distribution of editing of the PCSK9 exon 1 splice donor adenine base in the three animals that underwent necropsy at 2 weeks following treatment (n=1 sample per animal for each indicated organ except liver; the liver data represent the means shown in a calculated from eight liver samples each). The LNP constituted with ABE mRNA MA004 and guide RNA GA346 was used in this study, and the dose administered was 0.5 mg/kg.

Numeric formats of tissue distribution of editing of the PCSK9 exon 1 splice donor adenine base in three animals, as shown in FIG. 27.

| Tissue | control NHP | NHP #1 | NHP #2 | NHP #3 |
|---|---|---|---|---|
| Liver | 0.12 | 59.49 | 73.83 | 55.10 |
| Spleen | 0.02 | 5.25 | 7.99 | 5.67 |
| Adrenal gland (left) | 0.02 | 1.81 | 7.49 | 1.79 |
| Adrenal gland (right) | 0.10 | 1.54 | 0.22 | 2.18 |
| Kidney (left) | 0.10 | 0.63 | 0.89 | 0.24 |
| Kidney (right) | 0.06 | 0.64 | 0.27 | 0.32 |
| Skin (injection site) | 0.13 | 0.08 | 1.47 | 1.56 |
| Mandibular lymph nodes (left) | 0.06 | 0.15 | 0.48 | 0.43 |
| Mandibular lymph nodes (right) | 0.06 | 0.18 | 0.17 | 0.96 |
| Mesenteric lymph nodes | 0.04 | 0.12 | 0.15 | 0.12 |
| Testis (left) | 0.13 | 0.11 | 0.06 | 0.38 |
| Testis (right) | 0.07 | 0.16 | 0.09 | 0.38 |
| Epididymis (left) | 0.09 | 0.12 | 0.58 | 0.83 |
| Epididymis (right) | 0.80 | 0.25 | 0.79 | 0.52 |
| Skeletal muscle | 0.16 | 0.40 | 0.33 | 0.07 |
| Duodenum | 0.07 | 0.30 | 0.83 | 0.26 |
| Jejunum | 0.06 | 0.19 | 0.28 | 0.58 |
| Colon | 0.08 | 0.07 | 0.08 | 0.13 |
| Lung (left) | 0.01 | 0.16 | 0.22 | 0.18 |
| Lung (right) | 0.10 | 0.54 | 0.24 | 0.16 |
| Brain | 0.12 | 0.17 | 0.05 | 0.15 |

Figure 28:
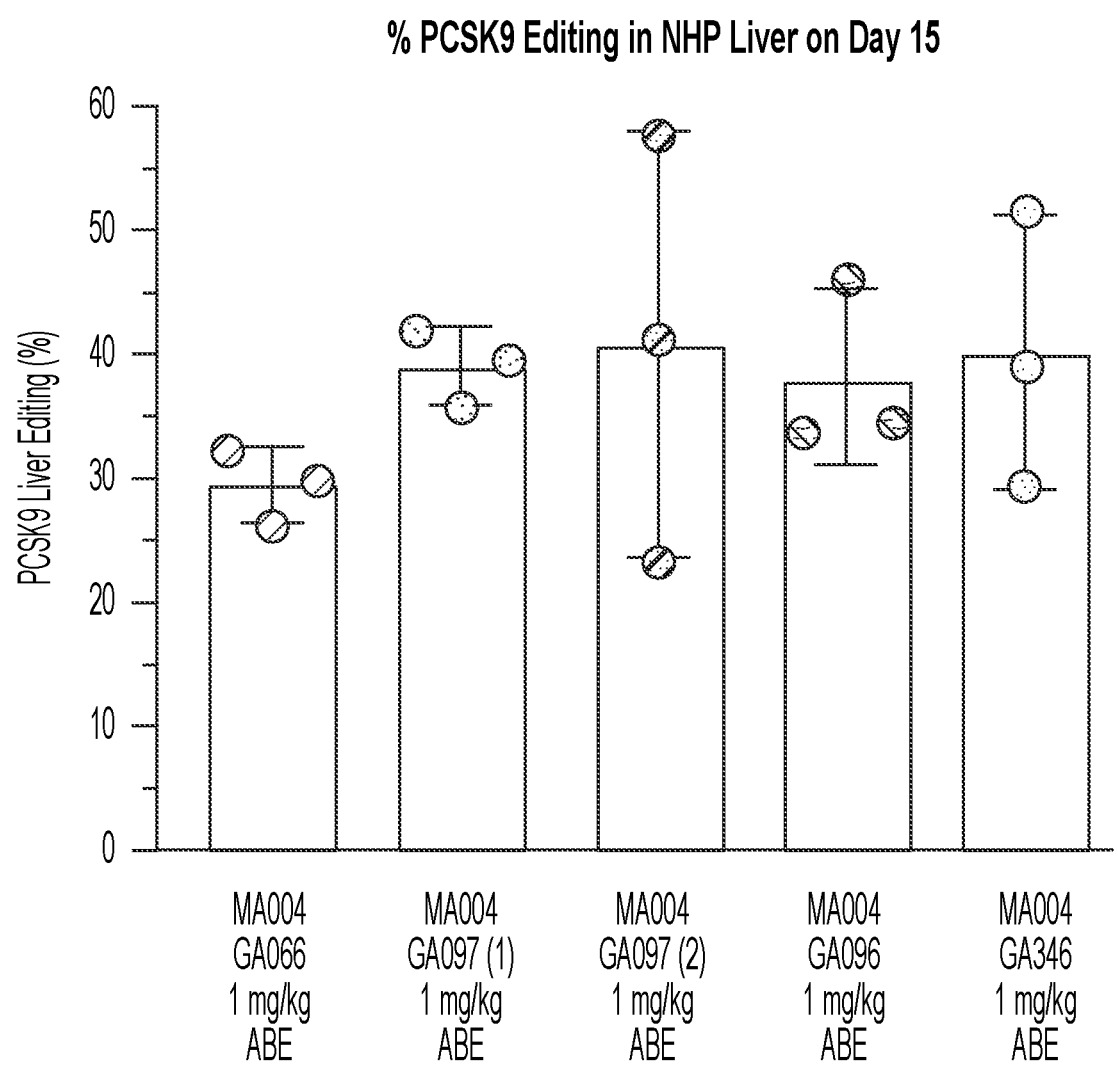
FIG. 28, GA096 (tracr1), GA097 (tracr2) and GA346 (tracr3). Black circle with white letter labels: 2'-OMe and phosphorothioate substitution, light gray circle with black letter labels: 2'-OMe substitution only, white circle with black letter labels: unmodified nucleotide. (SEQ ID NO: 73)

In an additional study, different tracr designs were assessed. LNPs were delivered in NHPs via intravenous infusion at a 1.0 mg/kg total RNA dose, unless otherwise specified. Base editing of the liver was assessed, and several guides outperformed GA066 with the literature tracr (FIG. 28).

Figure 29:
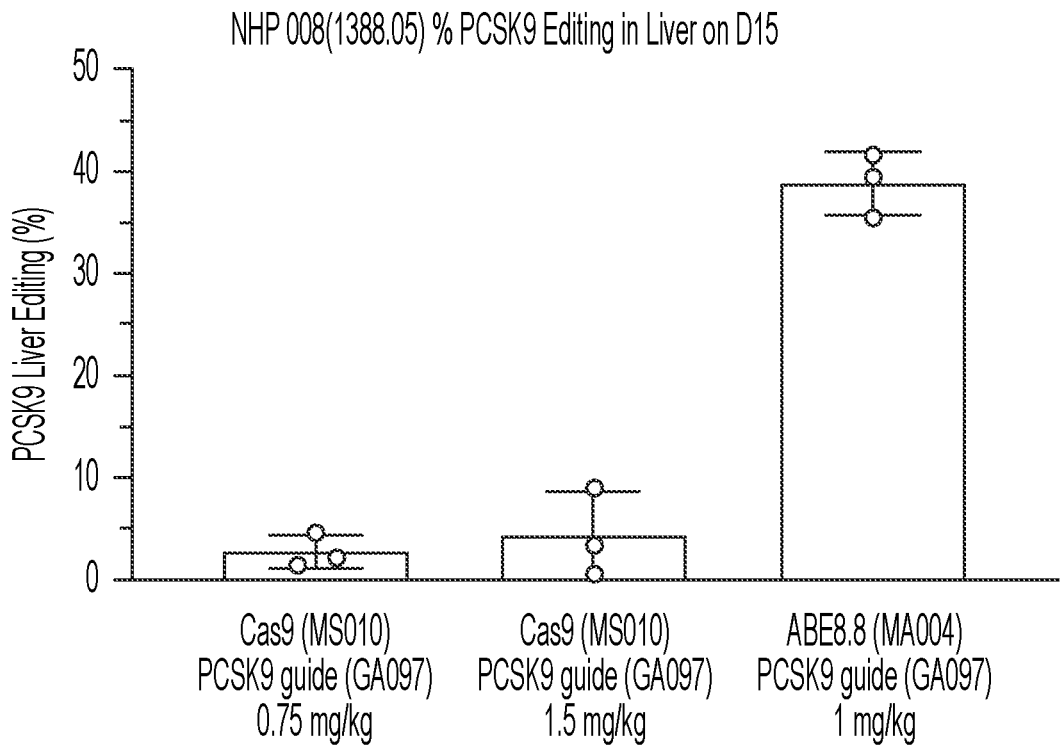
FIG. 29 shows SpCas9 nuclease versus adenine base editing of PCSK9 in non-human primates. LNPs containing either SpCas9 mRNA and PCSK9 gRNA, (MS010/GA097) or ABE8.8 mRNA and PCSK9 gRNA (MA004/GA097) were infused intravenously in cynomolgus monkeys. The MS010/GA097 LNP was dosed at 0.75 and 1.5 mg/kg, and the MA004/GA097 LNP was dosed at 1 mg/kg total RNA dose. The MS010/GA097 LNP test article at 1.5 mg/kg produced low single digit gene editing in NHP whereas the ABE/GA097 test article produced about 40% adenine base editing at 1 mg/kg, showing the robustness of ABE base editor over SpCas9 system. All LNPs used in this study were prepared using same excipients and compositions.

In the same NHP study, LNPs containing either: 1) Cas9 mRNA and a gRNA matching 5'-CCCGCACCTTGGCGCAGCGG-3' (SEQ ID NO: 13) (GA097) protospacer sequence; or 2) ABE8.8 mRNA and gRNA matching 5'-CCCGCACCTTGGCGCAGCGG-3' (SEQ ID NO: 13) (GA097) protospacer sequence, were delivered intravenously into NHPs. Importantly, the method by which classical CRISPR/Cas9 disrupts a gene by ultimately introducing an indel, is different than base editing where a base mutation has occurred. Further, a target region that is highly amenable to CRISPR/Cas9 editing does not necessarily mean base editing at that location will occur, and vice versa. This is highlighted in the NHP study, where the LNP containing SpCas9/gRNA resulted in low liver editing in the NHPs (<5%), while the LNP containing ABE8.8/gRNA had significantly higher editing close to 40% (FIG. 29) with a dose (1 mg/kg) lower than the SpCas9/gRNA dose (1.5 mg/kg).

In another study, two LNPs were compared for base editing activity after delivery in NHPs via intravenous infusion at doses ranging from 0.5 mg/kg-3.0 mg/kg. Both LNPs showed high efficacy, with the first LNP (LNP #1) outperforming the second LNP (LNP #2), at doses as low as 0.5 mg/kg having greater than 50% average editing (FIG.

Figure 31:
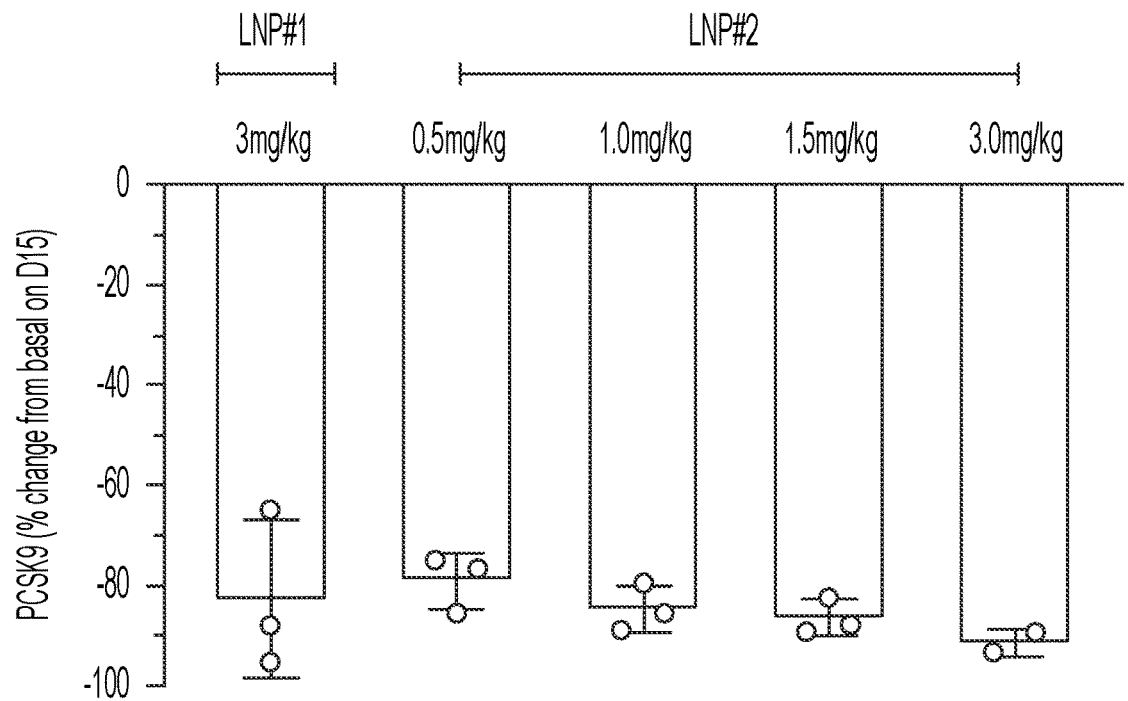
FIG. 31 shows the reduction of PCSK9 protein levels from basal on Day 15, from the same experiment described in FIG. 30.

30). Similar to past experiments, the PCSK9 protein levels decreased significantly upon high level of base editing at the splice site, decreasing circulating PCSK9 protein by 80-90% (FIG. 31).

Figure 32:
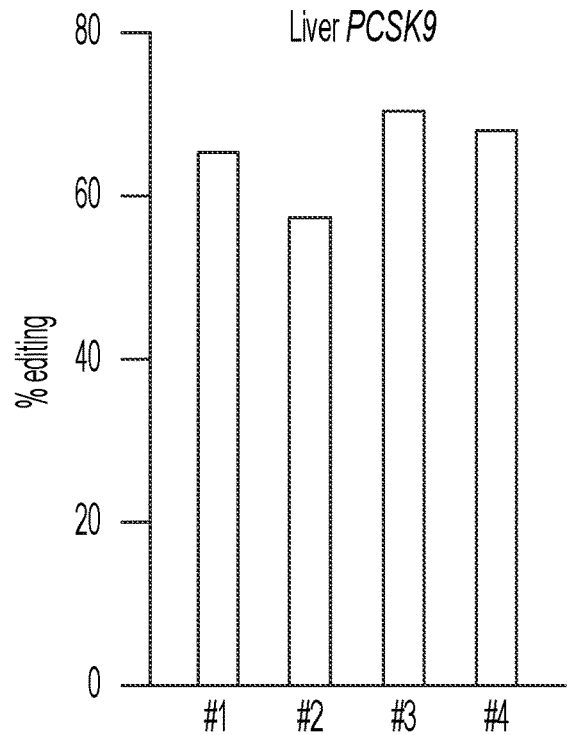
FIG. 32 depicts editing of the PCSK9 exon 1 splice-donor adenine base in the livers of four cynomolgus monkeys received an intravenous infusion of a 3 mg/kg total RNA dose of an LNP formulation with ABE8.8 mRNA MA004 and PCSK9 gRNA GA066. For each animal, editing was assessed in a liver biopsy sample at 2 weeks following treatment (n=1 sample per animal).
Figure 33:
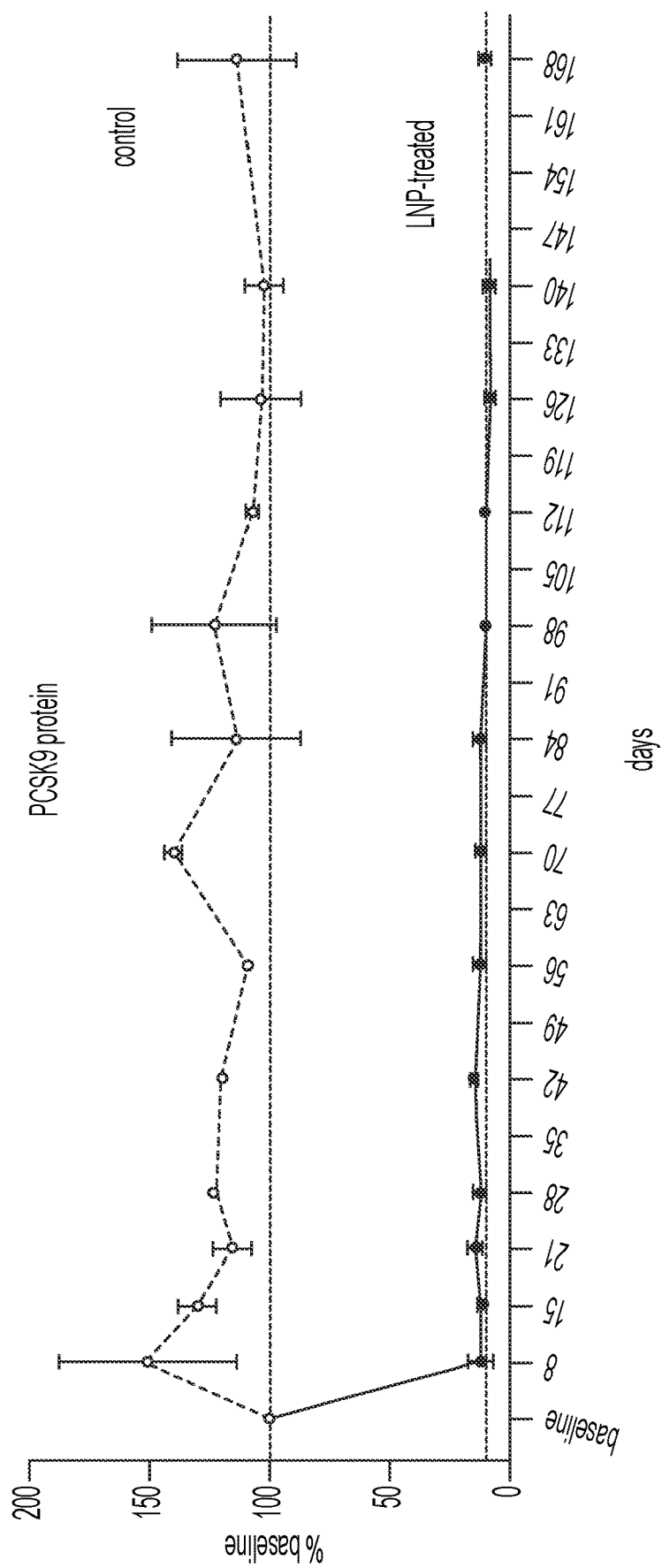
FIG. 33 depicts reduction of the blood PCSK9 protein levels in the four animals from FIG. 32 (animals that received 3 mg/kg total RNA dose of an LNP formulation with ABE8.8 mRNA MA004 and PCSK9 gRNA GA066) and in two contemporaneous control animals that received phosphate-buffered saline, comparing levels at various time points following treatment versus the baseline pre-treatment level (mean±standard deviation for each group, n=4 or n=2, at each time point). The dotted lines indicate 100% and 10% of baseline levels, respectively.
Figure 34:
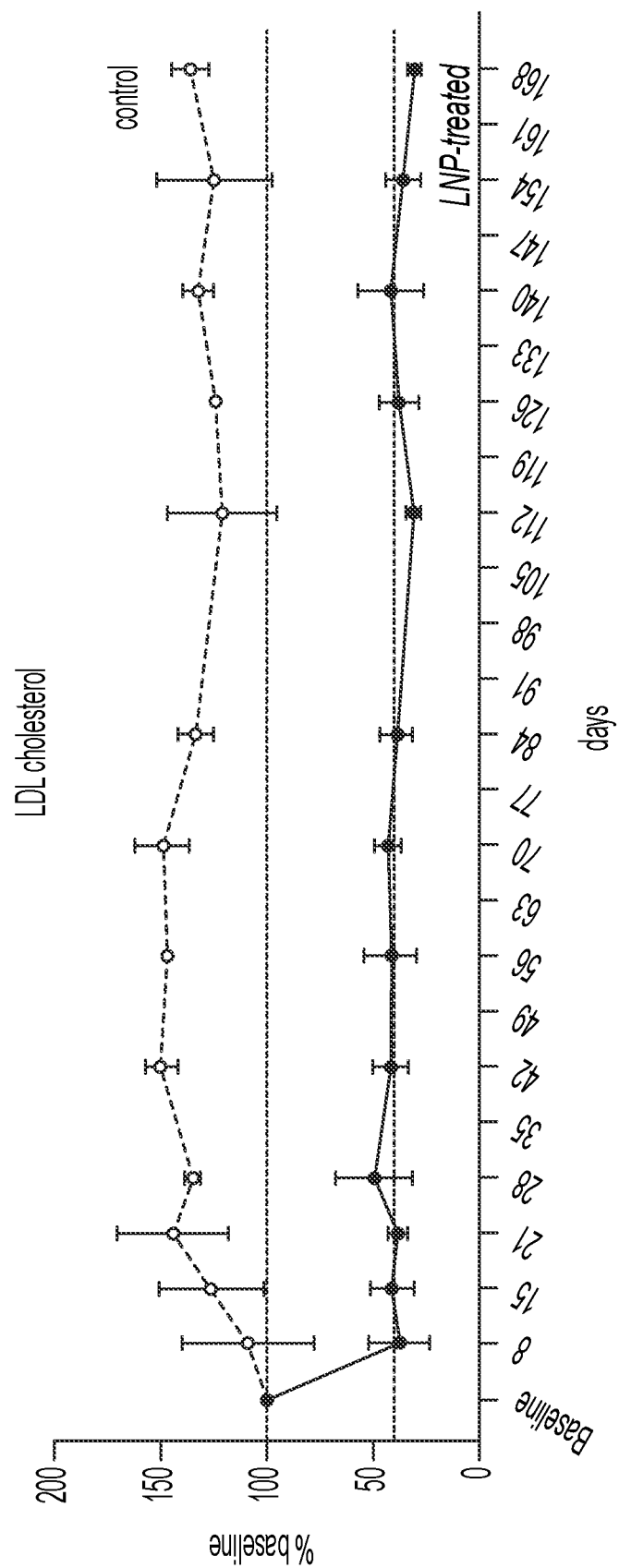
FIG. 34 depicts reduction of the blood LDL-C level in the four animals from FIG. 32 (animals that received 3 mg/kg total RNA dose of an LNP formulation with ABE8.8 mRNA MA004 and PCSK9 gRNA GA066) and in two contemporaneous control animals that received phosphate-buffered saline, comparing levels at various time points following treatment versus the baseline pre-treatment level (mean±standard deviation for each group, n=4 or n=2, at each time point). The dotted lines indicate 100% and 40% of baseline levels, respectively (top panel). The absolute values of individual animals are shown in the bottom panel.
Figure 34:
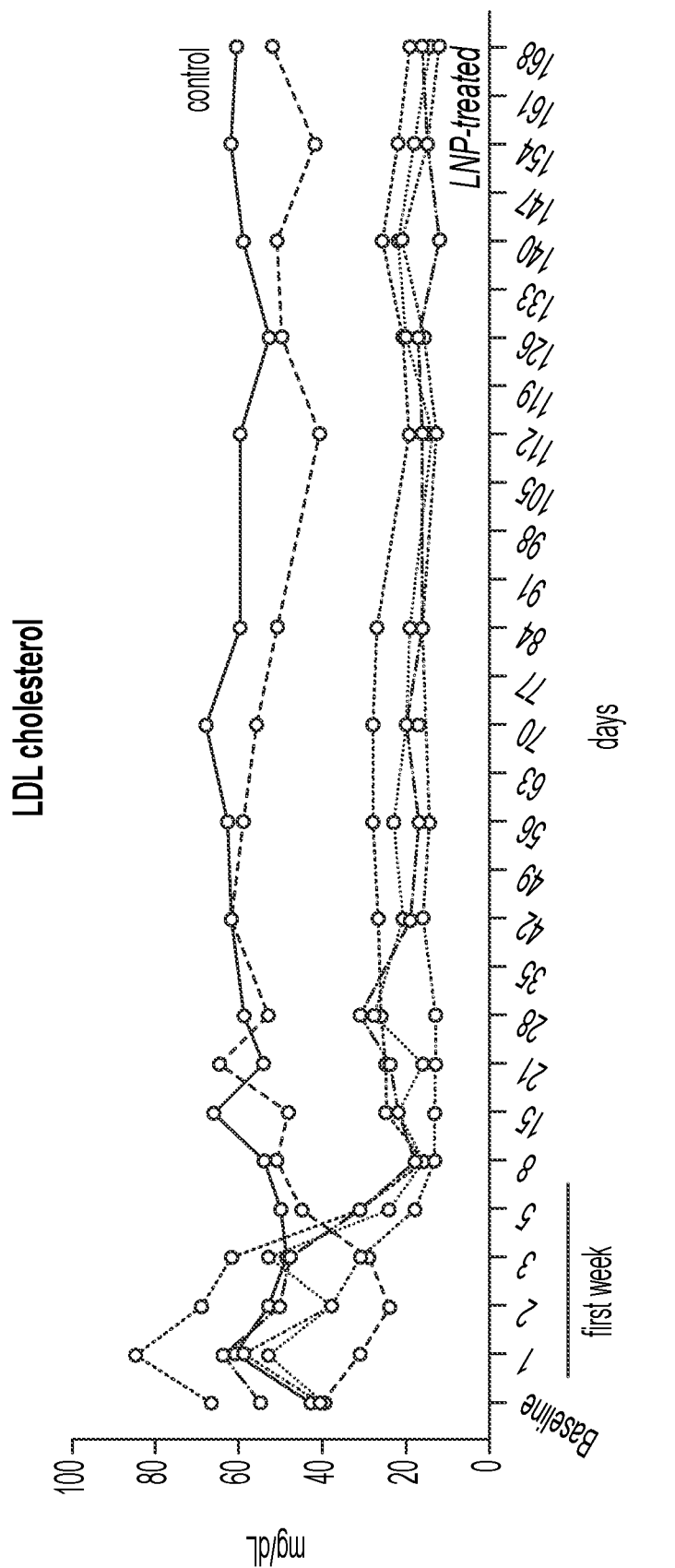
Figure 35:
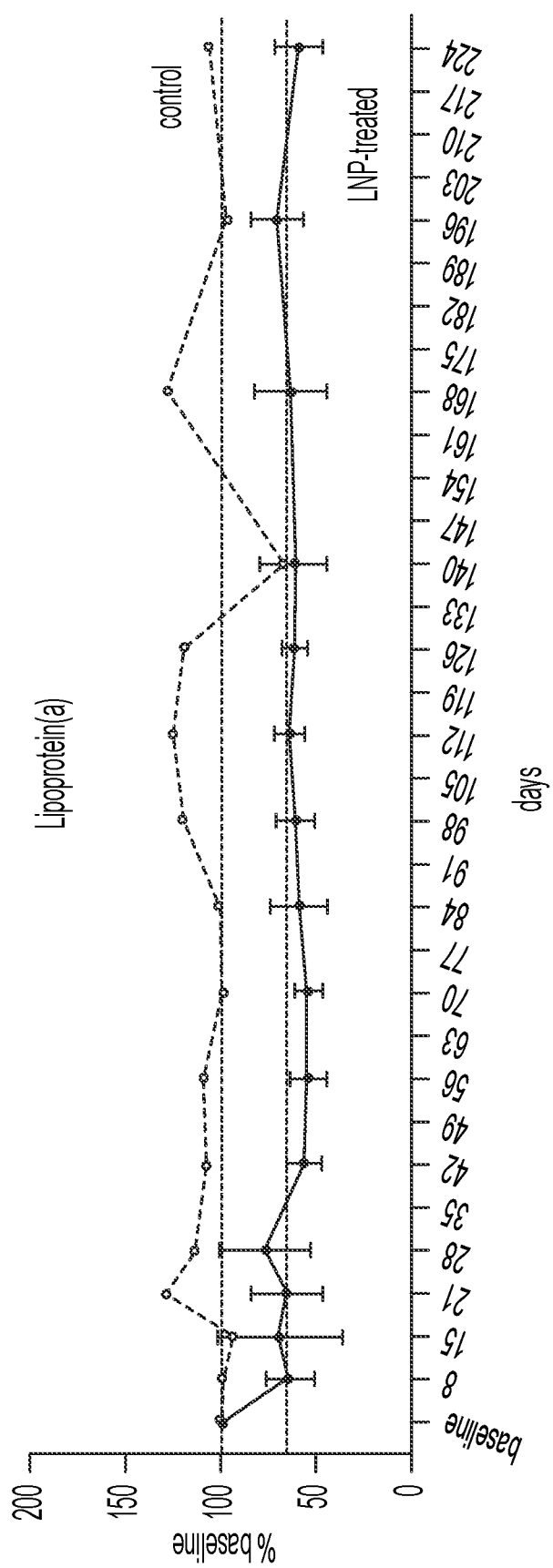
FIG. 35 depicts reduction of Lipoprotein(a) in the four animals from FIG. 32 and in two contemporaneous control animals that received phosphate-buffered saline, comparing levels at various time points following treatment versus the baseline pre-treatment level (mean±standard deviation for each group, n=4 or n=2, at each time point).

In a long-term study (four animals, with liver biopsy at 2 weeks) LNPs were introduced via intravenous infusion at a higher dose of 3.0 mg/kg to assess drug tolerability and the durability of PCSK9 protein and LDL-C reductions resulting from PCSK9 editing. The liver biopsy samples showed a mean 66% base editing frequency (FIG. 32). Blood PCSK9 protein levels reached a trough by 1 week and have remained stable thereafter out to at least 6 months, settling at approximately 90% reductions (FIG. 33). Blood LDL-C and lipoprotein(a) [Lp(a)] levels have similarly achieved stable troughs persisting to 8 months, settling at ~60% and ~35% reductions, respectively (FIG. 34, FIG. 35).

Figure 36:
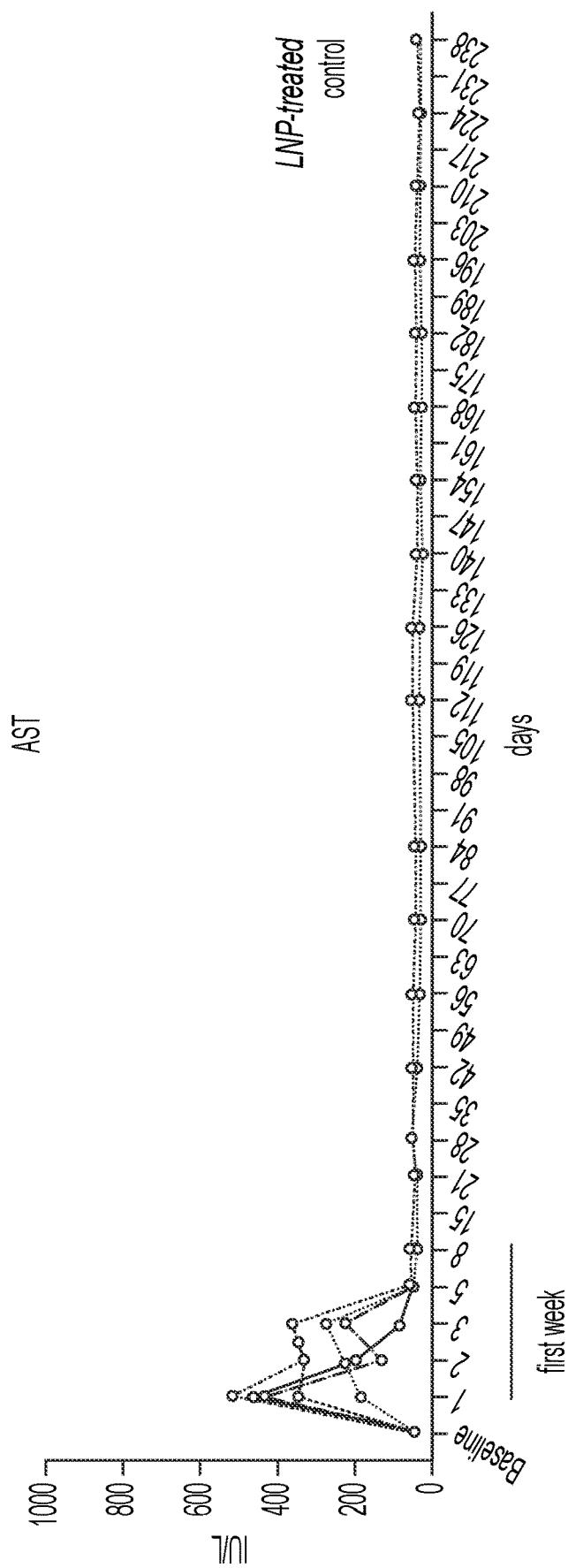
FIG. 36 shows long-term phenotypic effects of liver PCSK9 base editing in non-human primates. Absolute values of aspartate aminotransferase (AST) (top panel), and alanine aminotransferase (ALT) (bottom panel) in the individual animals portrayed in FIG. 32 (n=4 animals treated with 3 mg/kg dose of an LNP formulation with ABE8.8 mRNA and PCSK9-gRNA, and n=2 animals treated with phosphate-buffered saline) at various time points following treatment.
Figure 36:
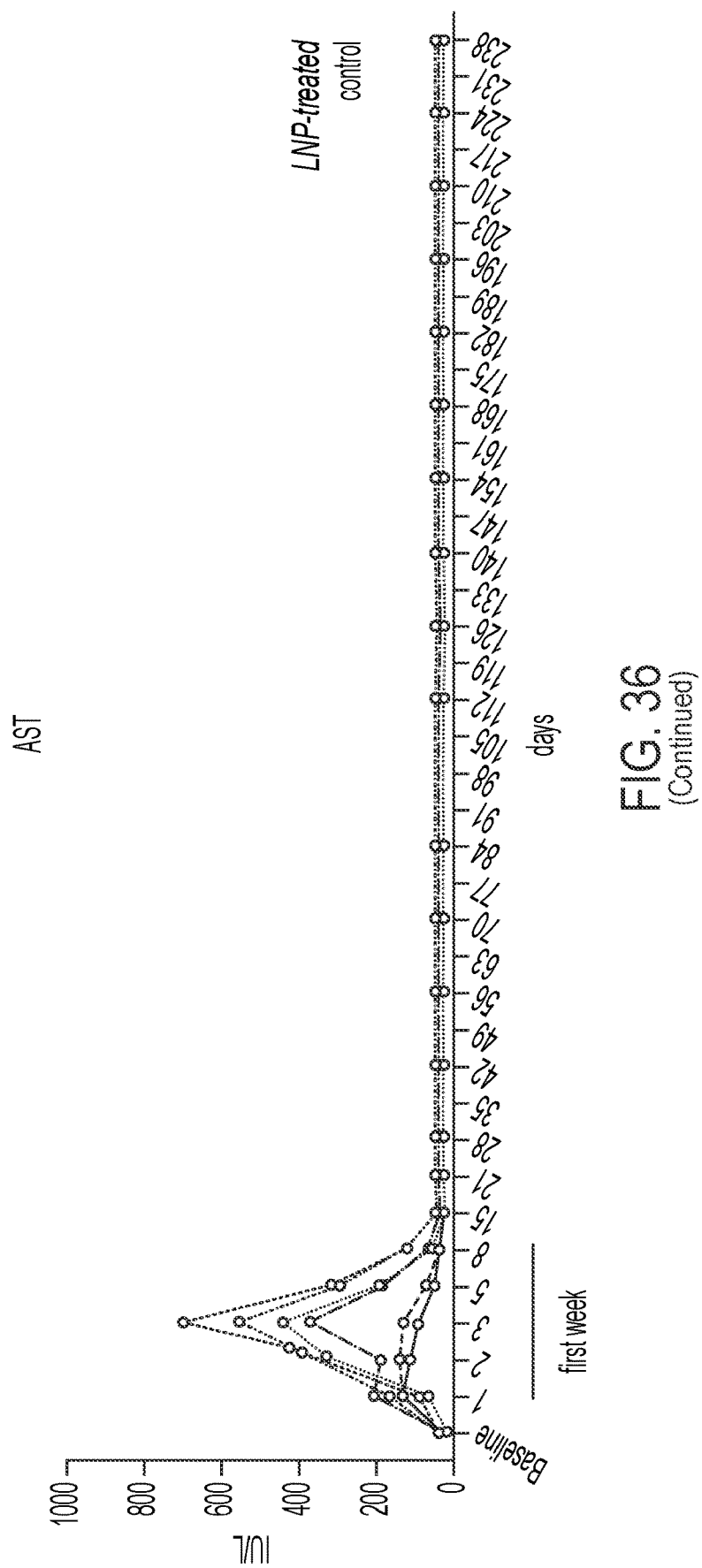
Figure 37A:
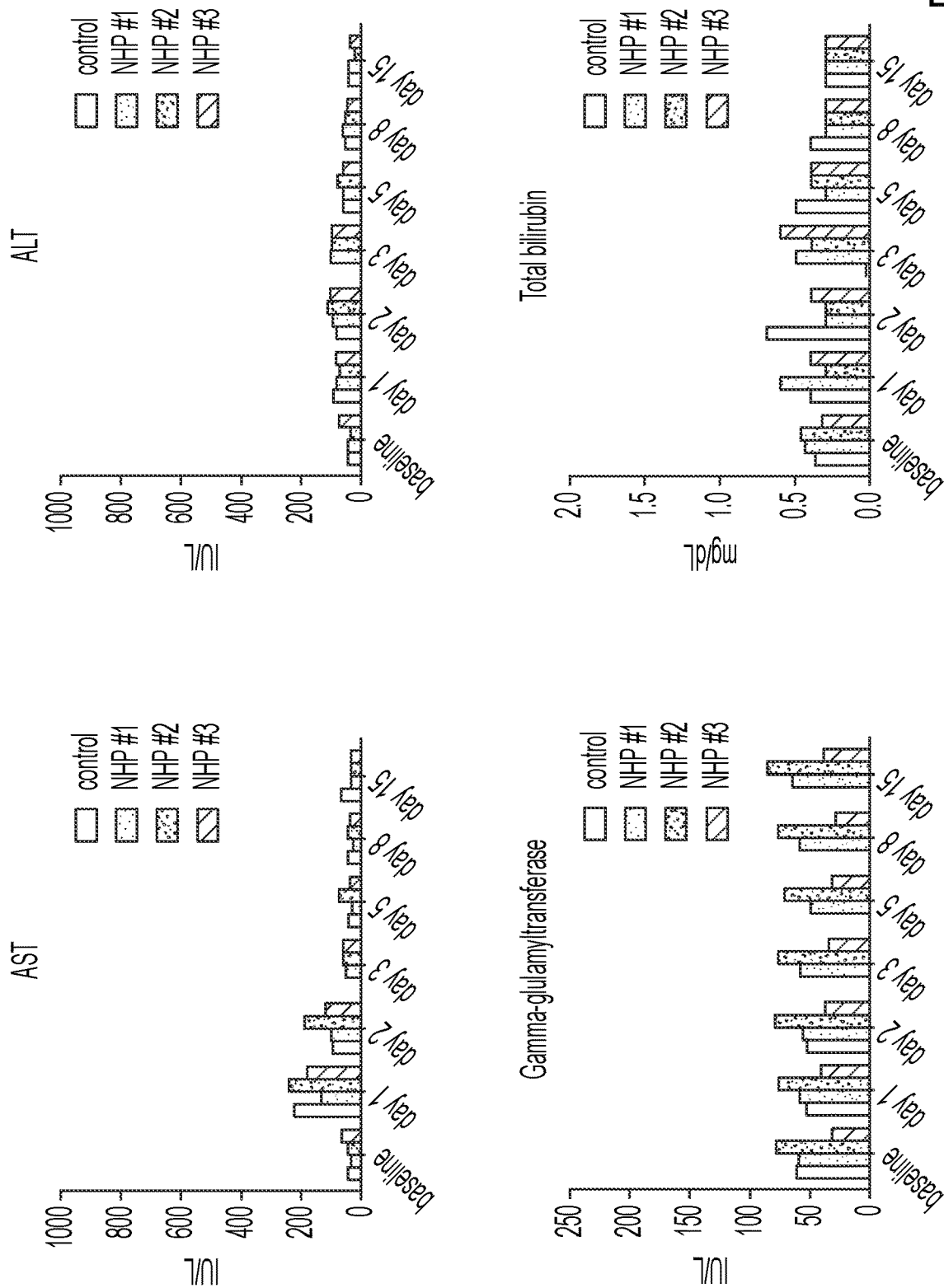
FIGS. 37A-37G show liver function markers of individual animals. AST (FIG. 37A, FIG. 37B), ALT (FIG. 37A, FIG. 37C), Alkaline phosphate (FIG. 37A, FIG. 37D), gamma-glutamyltransferase (FIG. 37A, FIG. 37E), total bilirubin (FIG. 37A, FIG. 37F), and albumin (FIG. 37A, FIG. 37G), up to 15 days post dose, from cynomolgus monkeys that received an intravenous infusion of a 0.5, 1.0, or 1.5 mg/kg dose of an LNP formulation with ABE8.8 mRNA and PCSK9 gRNA.
Figure 37A:
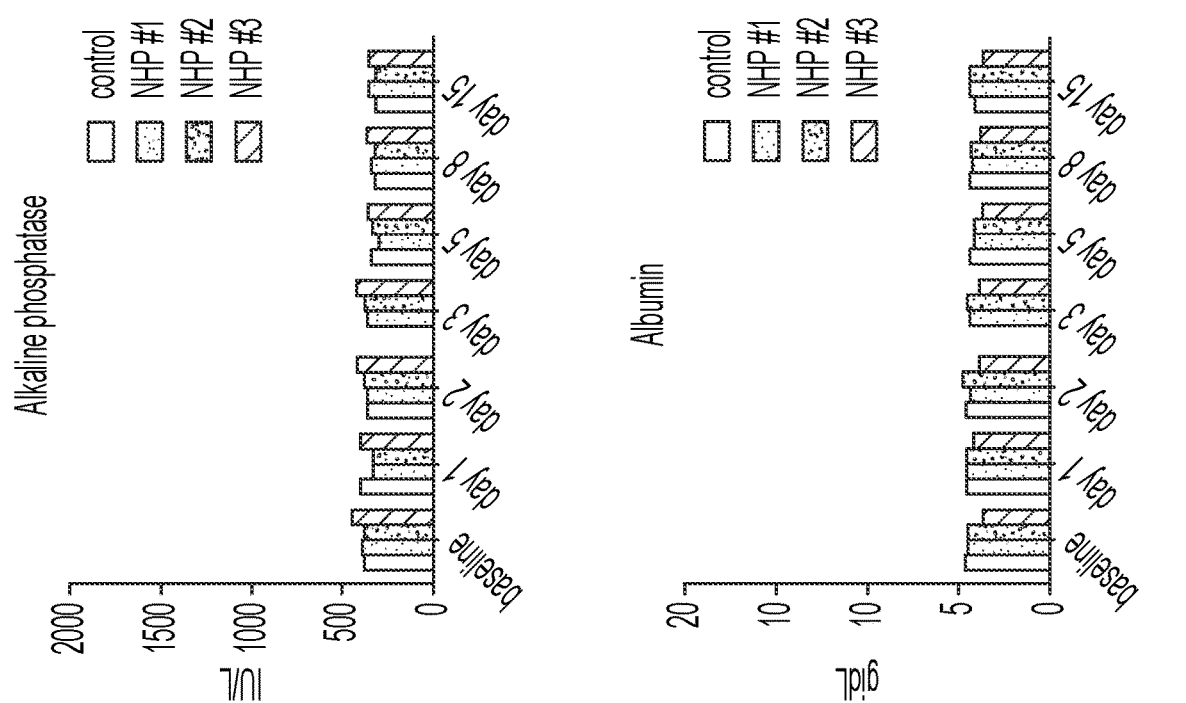
Figure 37B:
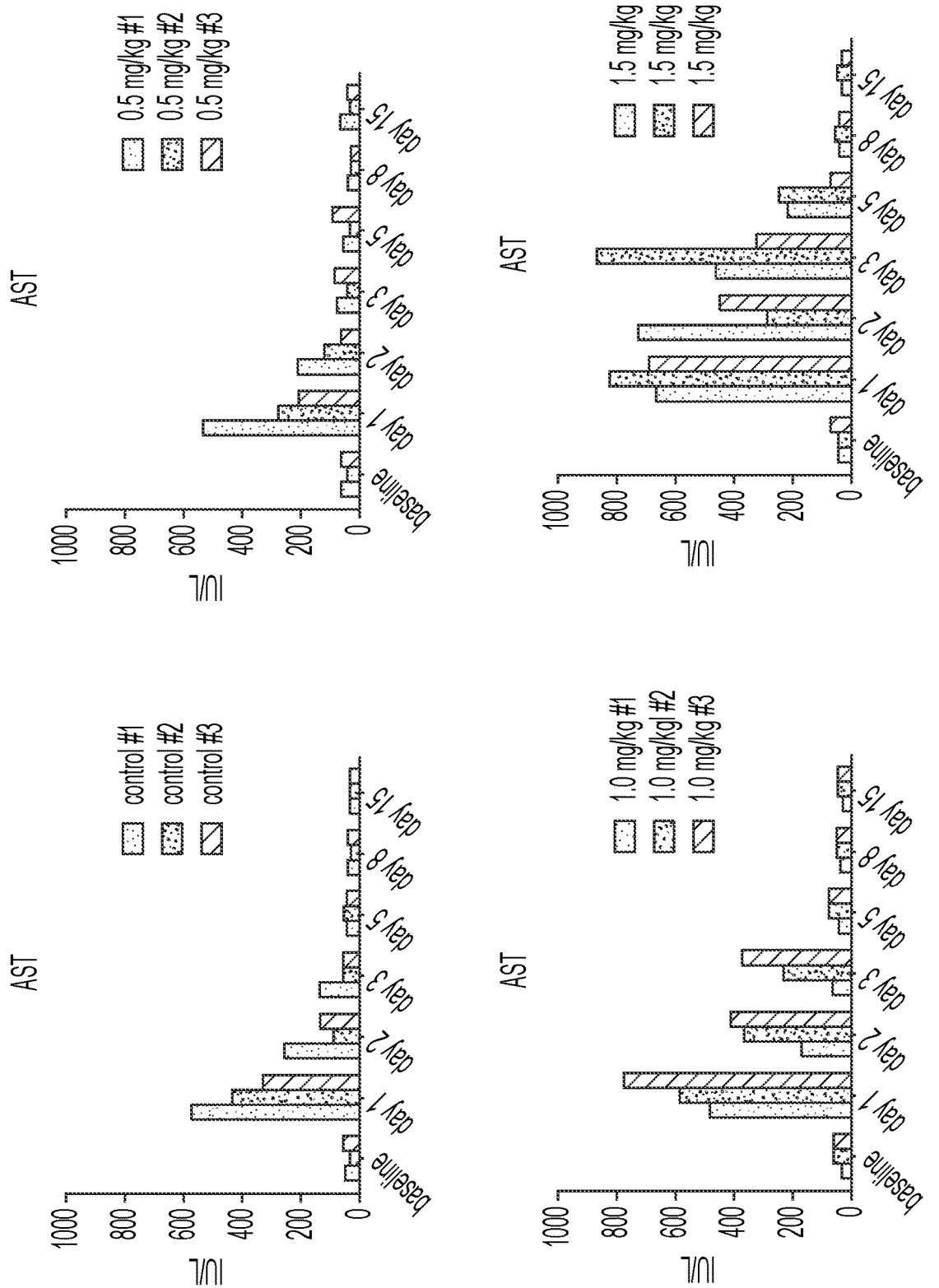
Figure 37C:
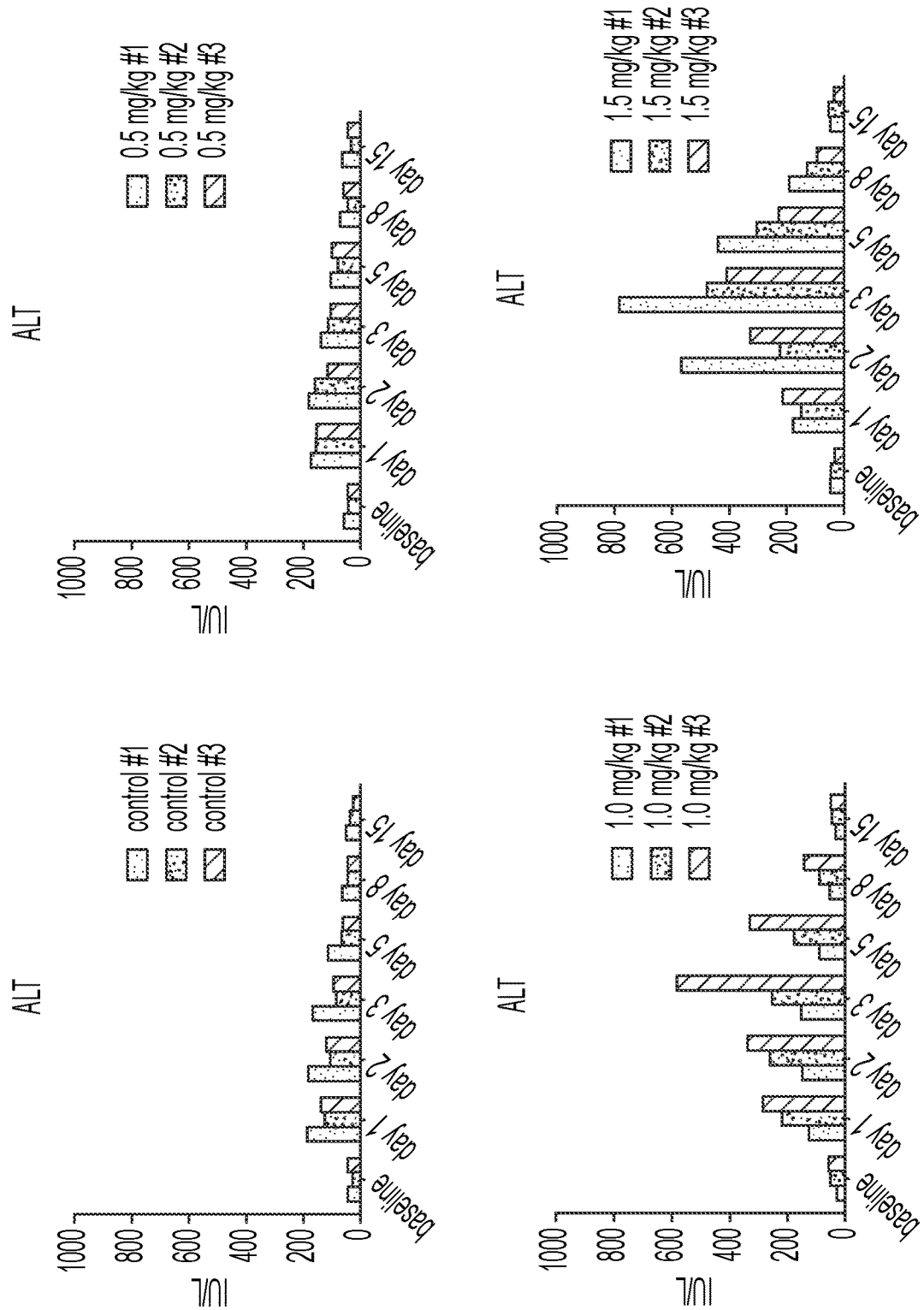
Figure 37D:
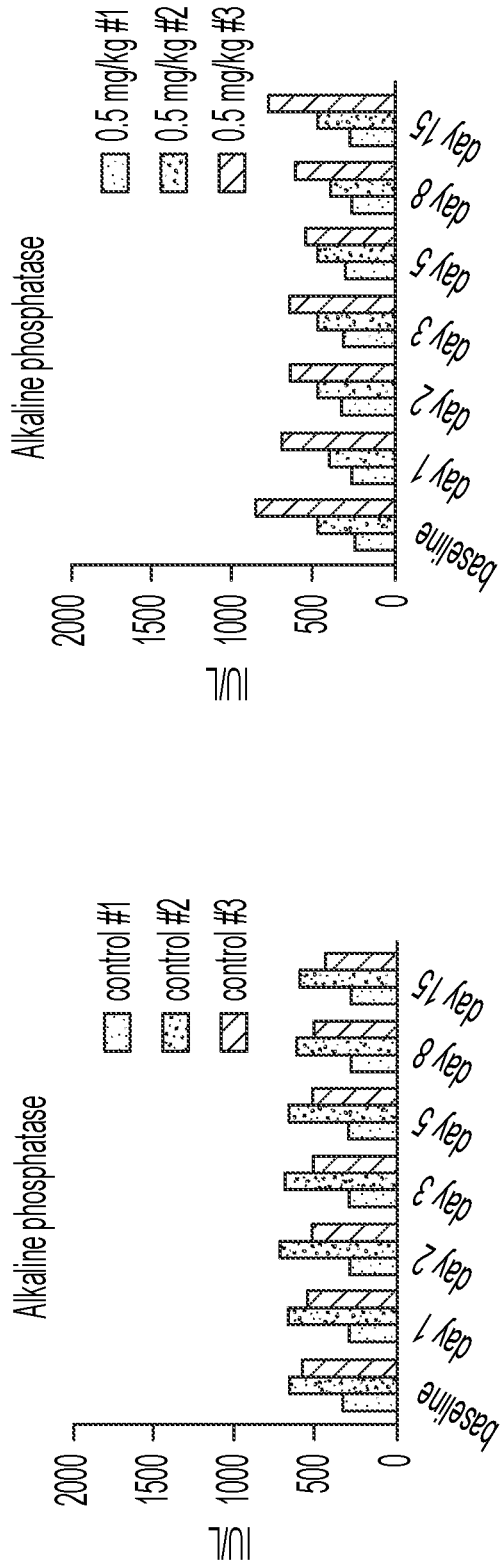
Figure 37D:
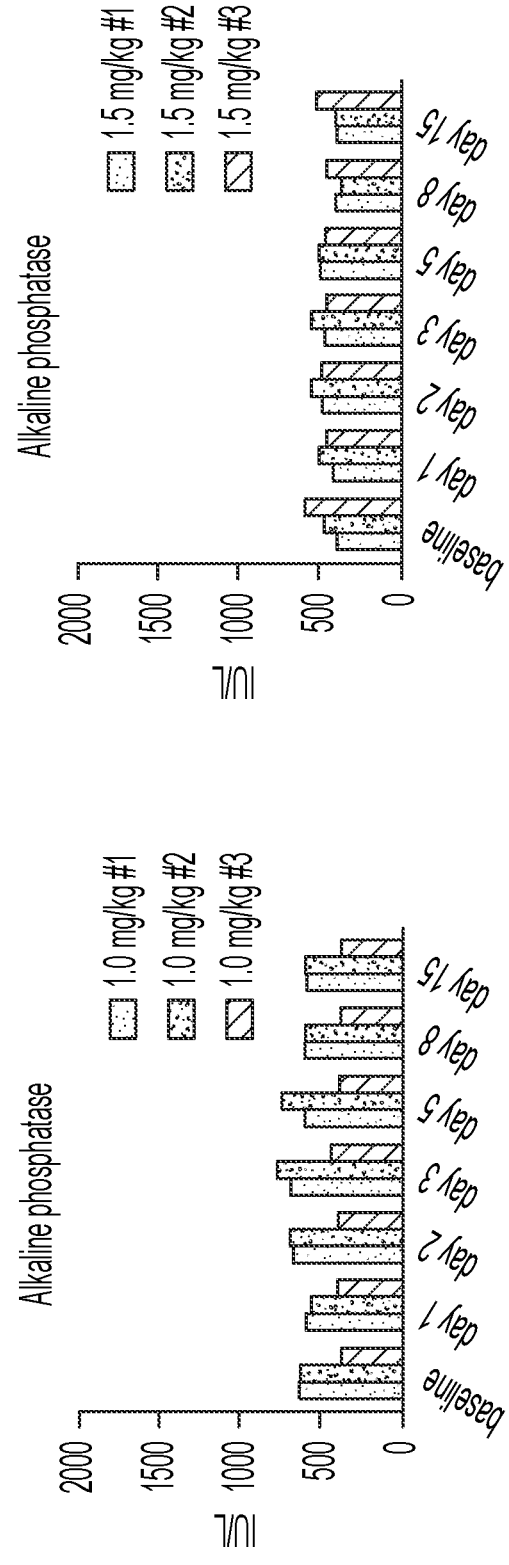
Figure 37E:
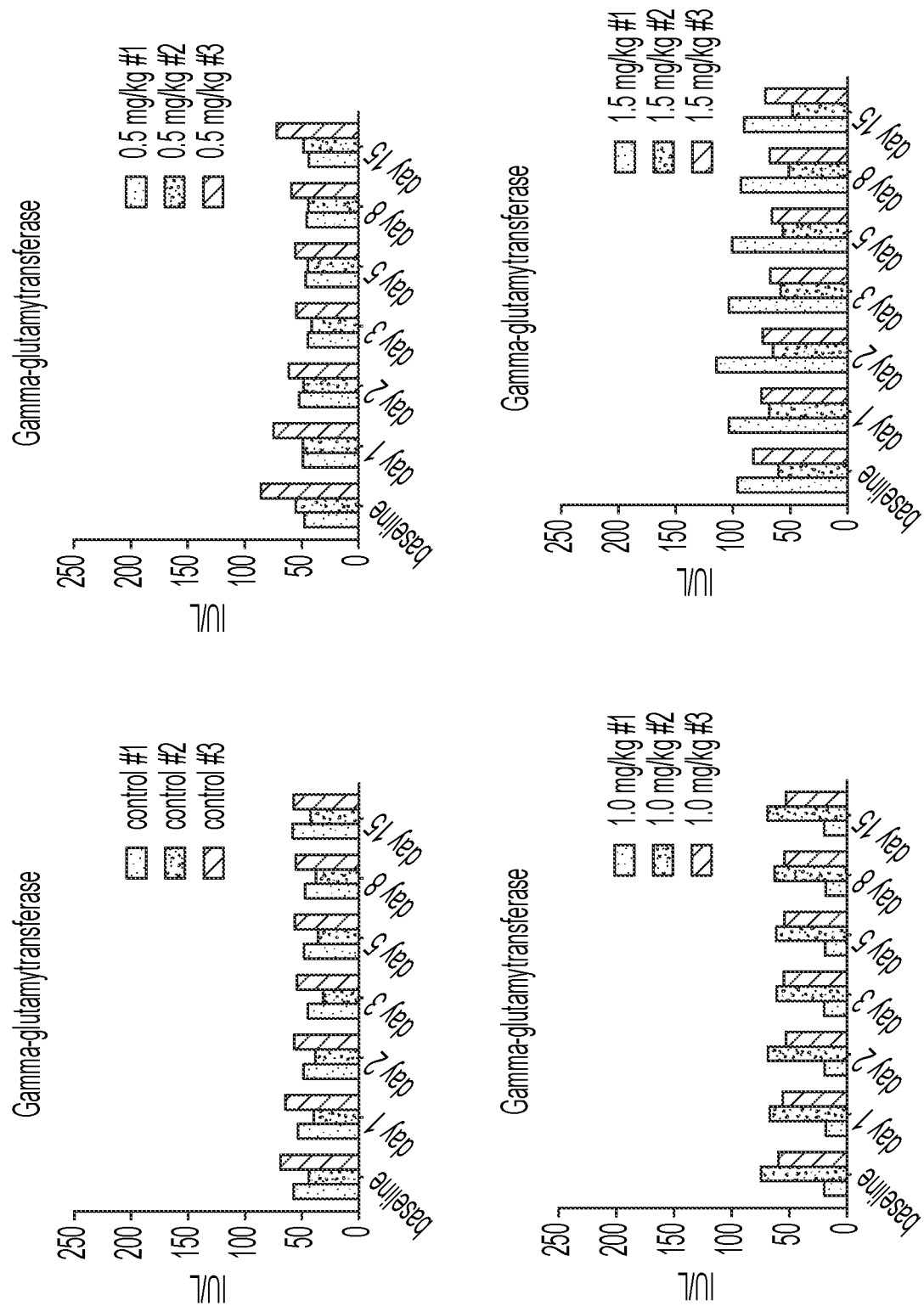
Figure 37F:
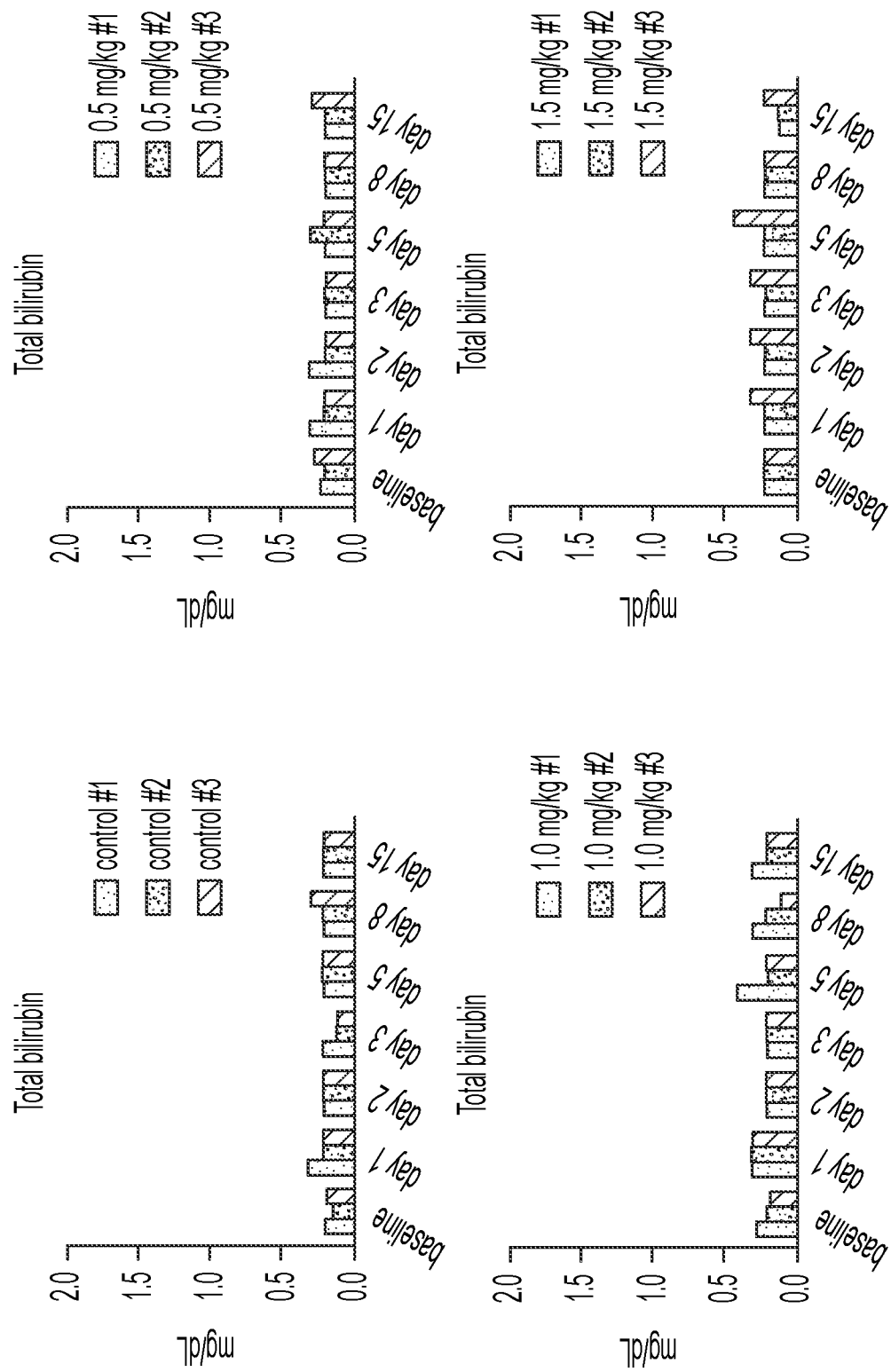
Figure 37G:
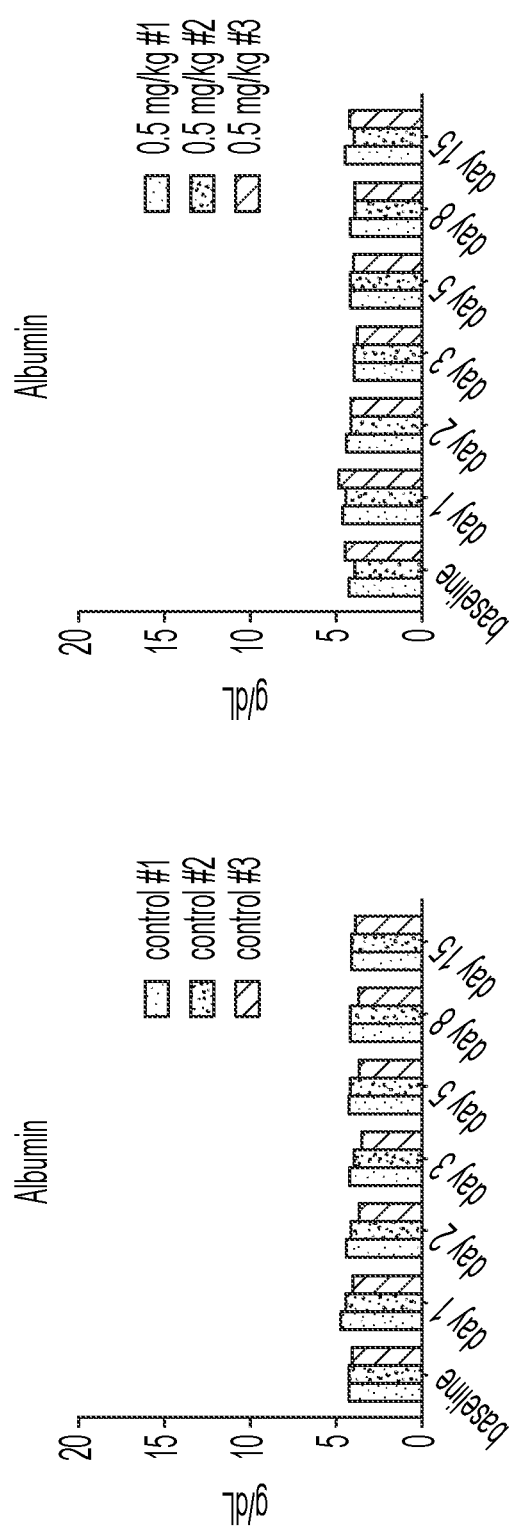
Figure 37G:
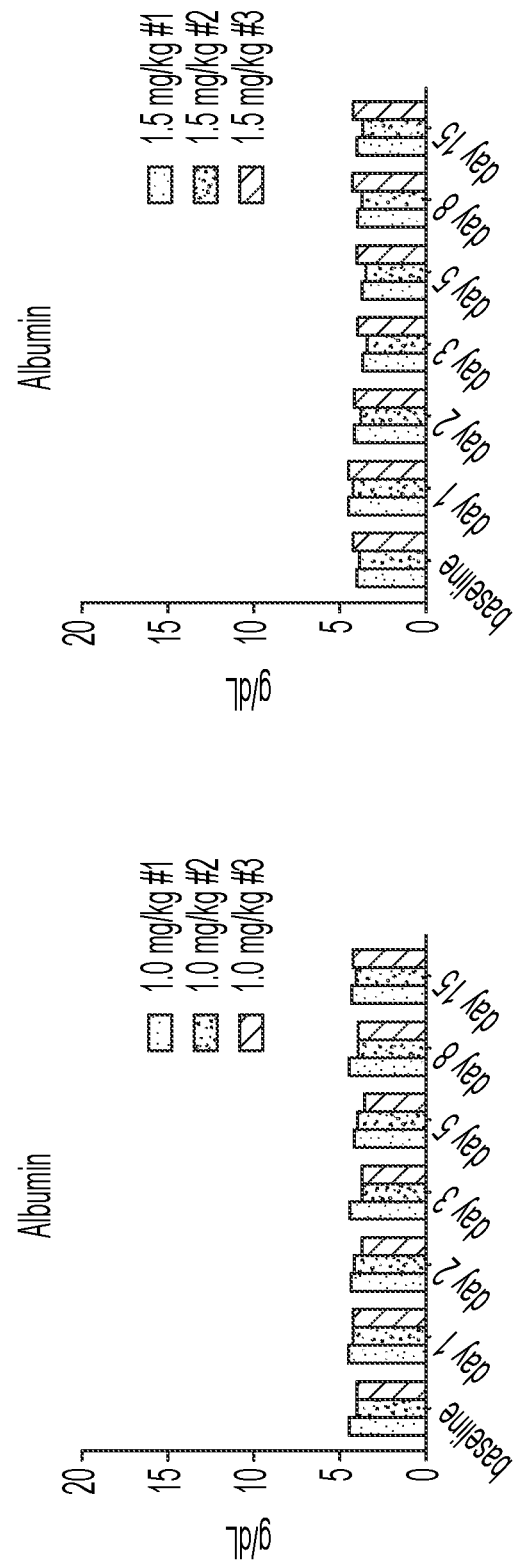

There were transient, moderate rises in AST and ALT that entirely resolved by 2 weeks following LNP infusion (FIG. 36), with no changes in any other liver function tests and no adverse health events observed to date (FIG. 37). Importantly, the persistence of PCSK9 and LDL-C reductions for 8 months with no late AST and ALT elevations demonstrates that such a response, whatever its scale, does not adversely impact the treatment's efficacy.

Figure 38:
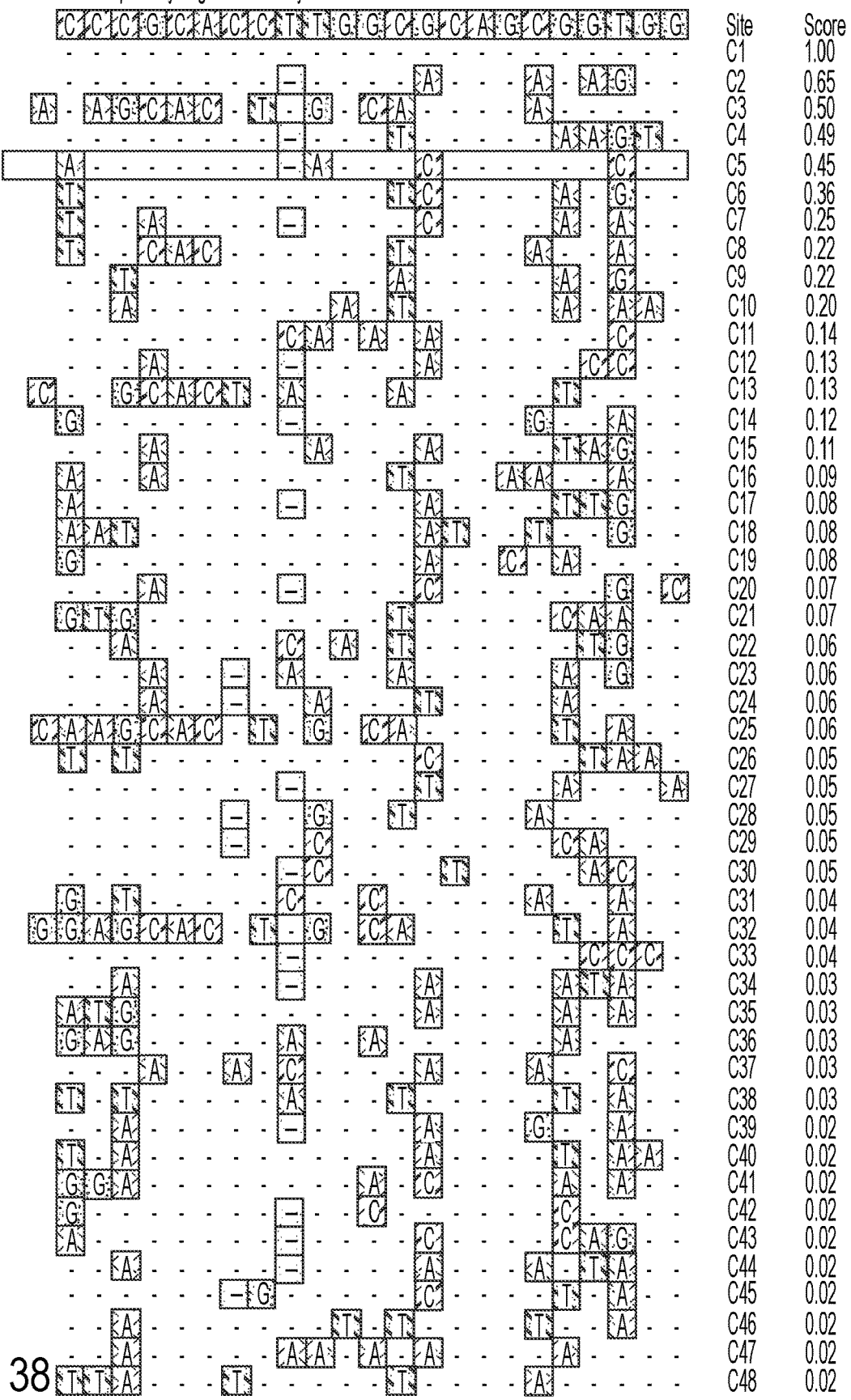
FIG. 38 is a schematic of the representative candidate ONE-seq sites using a specific library designed against the cynomolgus genome. The PCSK9 protospacer is depicted at the top with a ONE-seq score of 1.00. All sites listed are ranked by decreasing ONE-seq score, with mismatches to the protospacer sequence identified.

To evaluate ABE8.8/gRNA (protospacer matching GA346) LNP-mediated off-target editing in primary cyno hepatocytes and monkey liver samples, ONE-seq was performed with a synthetic cynomolgus genomic library selected by homology to the gRNA spacer sequence. This library was treated with ABE8.8 protein and PCSK9 gRNA, and the top 48 ONE-seq-nominated sites (FIG. 38)—of which the PCSK9 target site was the very top site-was assessed with next-generation sequencing of targeted PCR amplicons from LNP-treated versus untreated NHP samples (FIG. 39).

Figure 39:
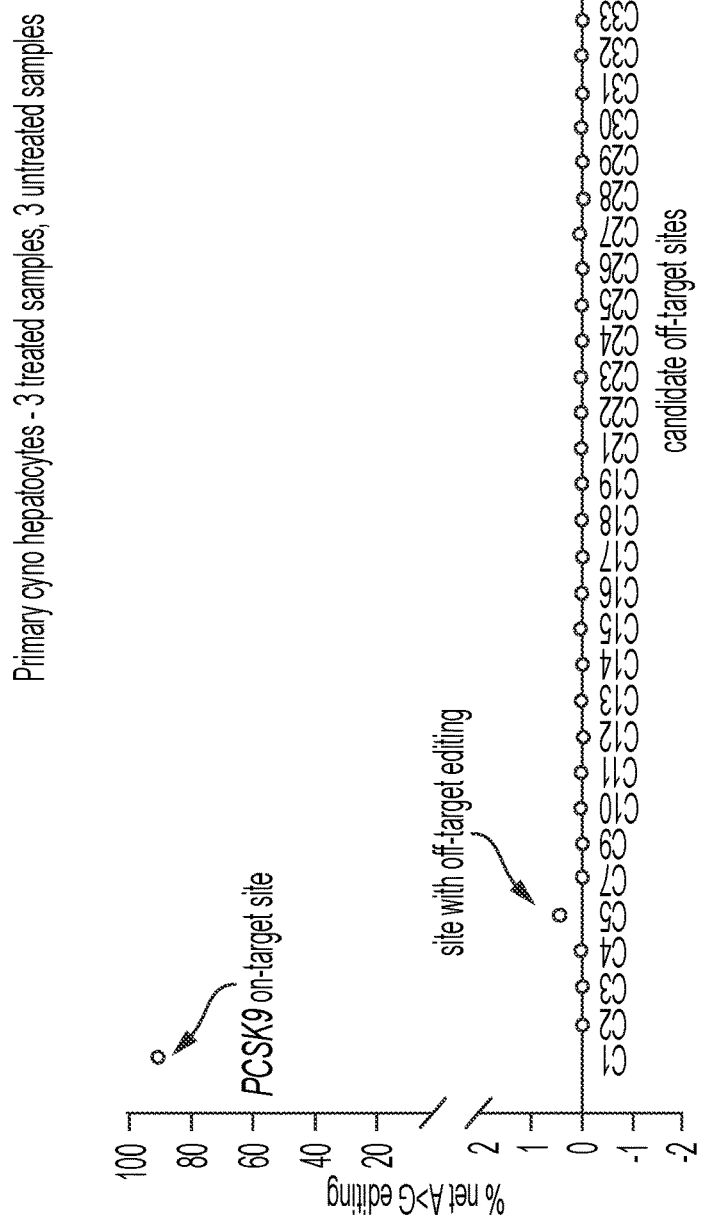
FIG. 39 shows gRNA-dependent, DNA off-target analysis of the sites identified in FIG. 38. Samples from cynomolgus primary hepatocytes (top panel) or cynomolgus monkey livers (bottom panel) were assessed for net A>G base editing (n=3 treated, n=3 untreated samples).
Figure 39:
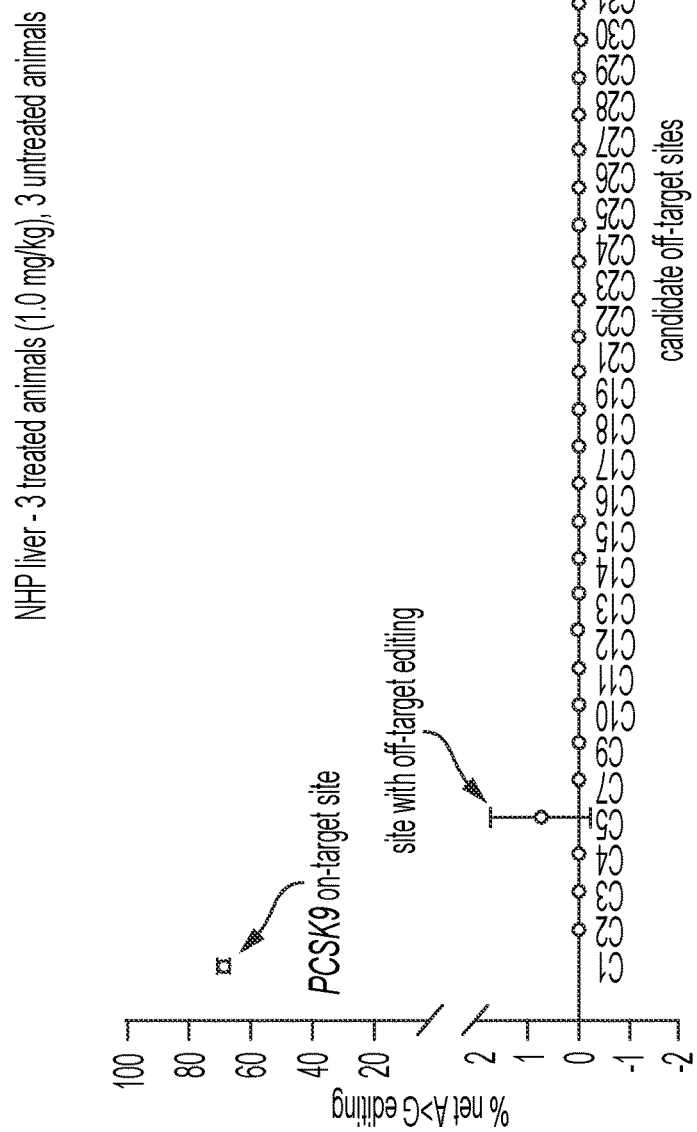
Figure 40:
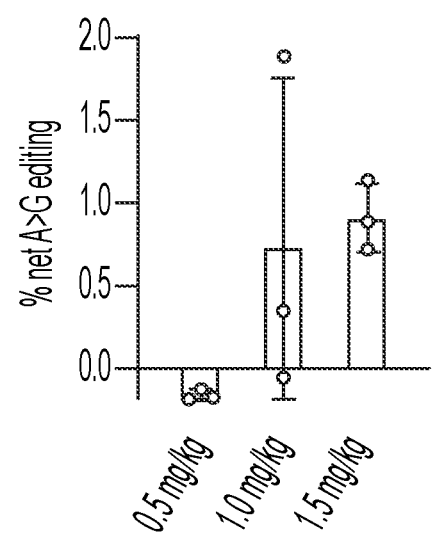
FIG. 40 shows net A>G % base editing at one off-target site (C5), identified in FIG. 39, from livers of NHPs that received either 0.5, 1.0, or 1.5 mg/kg LNP.

In LNP-treated primary cynomolgus hepatocytes, besides editing at the PCSK9 target site, there was off-target editing (mean <1%) evident at only one site, designated $C_5$, which has poor homology to the human genome (FIG. 39). Assessing the same 48 sites in liver samples from monkeys that were treated with a 1.0 mg/kg LNP dose (from the aforementioned dose-response study), low-level off-target editing (mean <1%) only at the $C_5$ site (FIG. 40) was observed. No off-target editing with a 0.5 mg/kg LNP dose and only low-level off-target editing with a 1.5 mg/kg LNP dose (mean <1%) were detected.

Example 9. Evaluation of ANGPTL3 ABE

Similar to the NHP studies performed with the ABE/PCSK9 guide(s), LNPs formulated with ABE8.8 mRNA and a gRNA with the 5'-AAGATACCTGAATAACTCTC-3' (SEQ ID NO: 14) (GA067) cynomolgus spacer was administered to cynomolgus monkeys via intravenous infusion at two doses, 3 mg/kg (n=3 animals) and 1 mg/kg (n=2 animals) with the intent of producing high-level base editing of ANGPTL3 in the liver. Two weeks after administration of test article, blood samples were collected for clinical chemistry assays and ANGPTL3 ELISA assay, and the animals underwent necropsy for collection of liver samples. Small segments from the center and periphery of each lobe of the liver were excised and flash frozen in liquid nitrogen and stored at −86 to −60° C. Splice-site editing was analyzed by next generation sequencing, confirming that base change occurred. At the highest dose (3 mg/kg), a mean of 61% editing of the adenine base was observed at the target splice site in the liver; at the lowest dose (1 mg/kg), the editing observed was 28% at the target splice site in the liver (Table 19).

In addition, blood samples were collected pre-dose, on D7 and D15 post-dose to determine serum ANGPTL3, and triglycerides. At two weeks after dosing there was a mean 90% and 31% reduction in the blood ANGPTL3 protein level compared to pre-dosing levels in the higher (3 mg/kg) and lower (1 mg/kg) dosing groups (Table 20).

TABLE 19

Liver Editing in cynomolgus monkeys

| Group | Dose (total RNA, mg/kg) | Animal ID | Mean ± standard deviation |
|---|---|---|---|
| 1 | 0 | 1001 | 0.25 ± 0.06 |
| 4 | 1 | 4001 | 39.6 ± 2.7 |
| 4 | 1 | 4002 | 15.1 ± 3.9 |
| 5 | 3 | 5001 | 61.2 ± 3.2 |
| 5 | 3 | 5002 | 56.4 ± 5.2 |
| 5 | 3 | 5003 | 64.3 ± 2.6 |

TABLE 20

Knockdown of circulating cynomolgus monkey ANGPTL3 following gene editing using ABE

| Group | Dose (total RNA, mg/kg) | Animal ID | Concentration (ng/ml) Basal | D8 | D15 | Reduction from basal on D15 (%) |
|---|---|---|---|---|---|---|
| 1 | 0 | 1001 | 39 | 47 | 41 | −7 |
| 4 | 1 | 4001 | 56 | 15 | 31 | 45 |
| 4 | 1 | 4002 | 38 | 22 | 31 | 17 |
| 5 | 3 | 5001 | 31 | 1 | 1 | 98 |
| 5 | 3 | 5002 | 33 | 11 | 9 | 72 |
| 5 | 3 | 5003 | 70 | 1 | 1 | 99 |

Triglycerides were determined in serum samples taken pre-dose and on D8 and D15 using a standard clinical analyzer. Serum triglyceride reduction in response to LNP-mediated ANGPTL3 base editing with ABE8.8 and GA067 are summarized in Table 21. The levels of triglycerides were reduced by 24% and 59% in response to doses of 1 mg/kg and 3 mg/kg base editor ABE8.8 and GA067 targeting ANGPTL3.

TABLE 21

Triglyceride reduction in response to ANGPTL3 gene in liver

| Group | Dose (total RNA, mg/kg) | Animal ID | Triglyceride concentration (mg/dl) Basal | D8 | D15 | Reduction from basal on D15 (%) |
|---|---|---|---|---|---|---|
| 1 | 0 | 1001 | 31.3 | 43 | 41 | −31 |
| 4 | 1 | 4001 | 71.0 | 46 | 49 | 31 |
| 4 | 1 | 4002 | 67.7 | 52 | 56 | 17 |
| 5 | 3 | 5001 | 59.3 | 23 | 21 | 65 |
| 5 | 3 | 5002 | 41.3 | 33 | 25 | 40 |
| 5 | 3 | 5003 | 55.0 | 27 | 15 | 73 |

Figure 41:
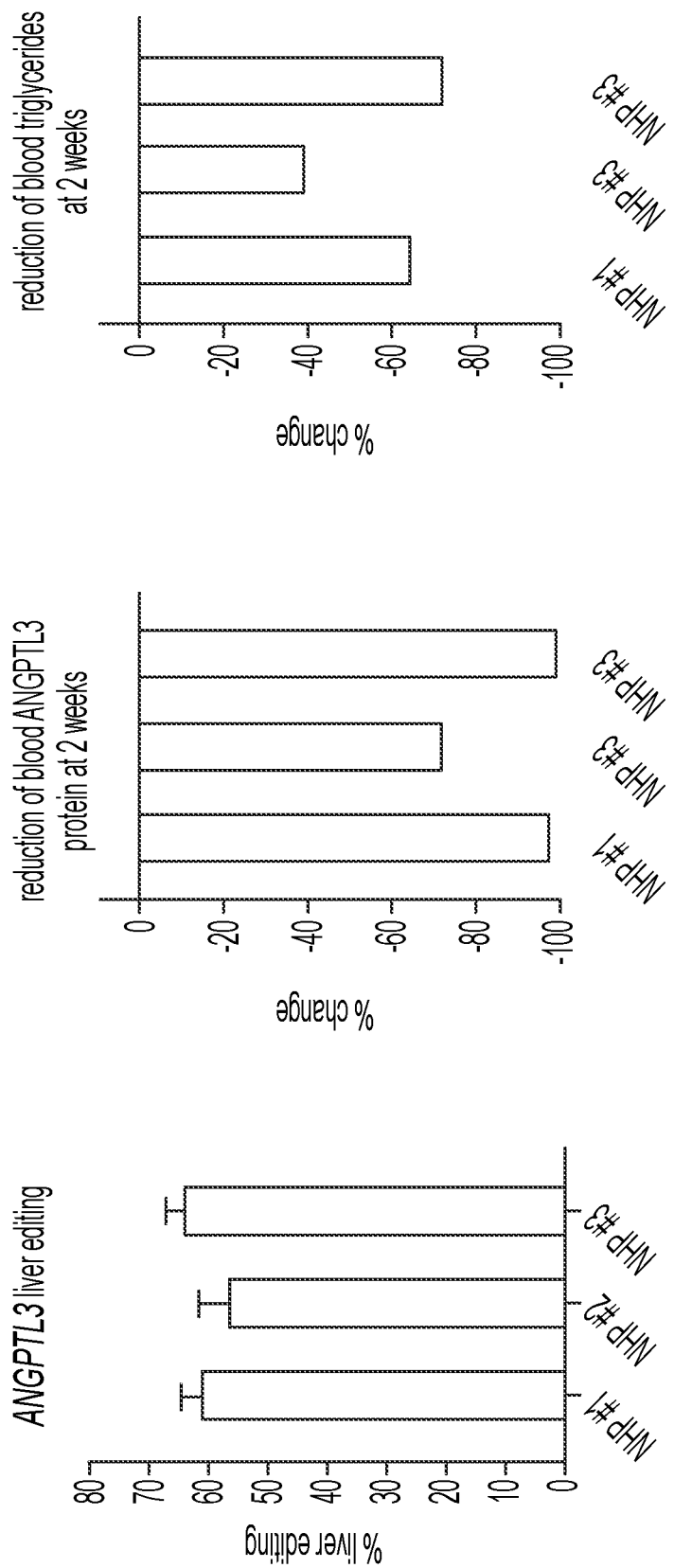
FIG. 41 shows base editing of ANGPTL3 in NHPs via LNPs formulated with an embodiment of base editor system, ABE mRNA MA004 and ANGPTL3 guide RNA GA067. Liver editing (left panel), ANGPTL3 protein levels (middle panel), and triglyceride levels (right panel) are shown for three NHPs.

In another independent study, the same ABE8.8/GA067 LNP was administered to cynomolgus monkeys via intravenous infusion at a dose of 3 mg/kg (n=3 animals) with the intent of producing high-level base editing of ANGPTL3 in the liver. Two weeks after administration of test article, blood samples were collected for clinical chemistry assays, and the animals underwent a liver biopsy for collection of liver samples. At the 3 mg/kg dose, a mean of 60% editing of the adenine base at the target splice site was achieved in the liver biopsy samples. Concordantly, at 2 weeks after dosing there was a mean 95% reduction in the blood ANGPTL3 protein level compared to pre-dosing levels and there was a mean 64% reduction in the blood triglyceride level (FIG. 41). These results provide an additional preclinical proof of concept of a base-editing therapy knocking down ANGPTL3 in the liver in vivo and effecting reductions in blood ANGPTL3 protein and triglyceride levels.

Example 10. Evaluation of Dual PCSK9 and ANGPTL3 Base Editing

Figure 42:
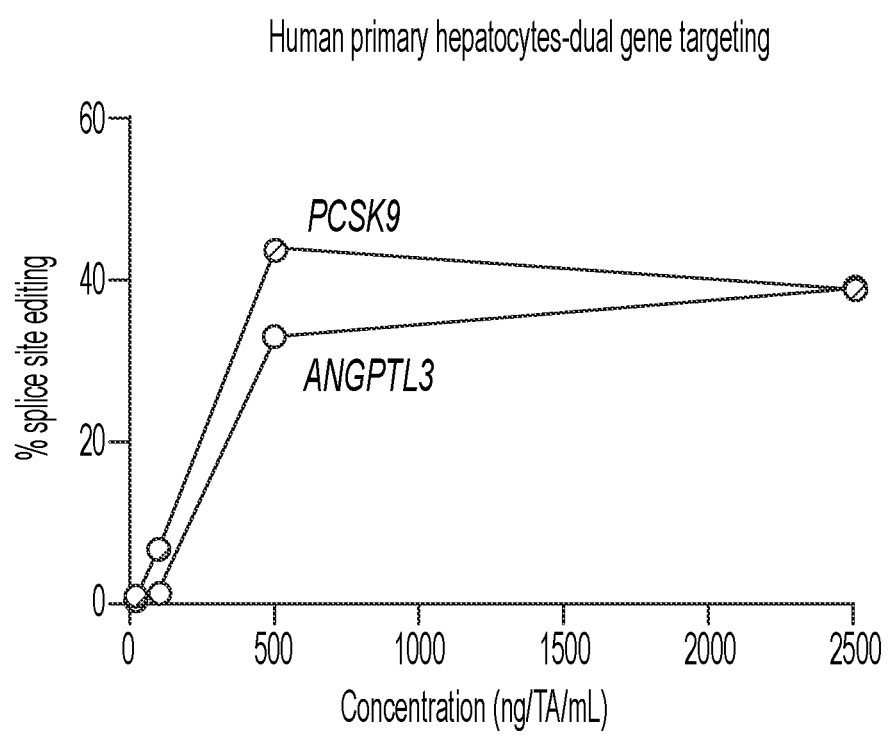
FIG. 42 shows simultaneous ANGPTL3 and PCSK9 base editing with lipid nanoparticles (LNPs) formulated with an embodiment of base editor system, ABE mRNA MA002 and dual guide RNAs GA095 (hcPCSK9) and GA098 (hANGPTL3), in human primary hepatocytes at concentrations ranging from 0-2500 ng/test article/mL.

To assess whether it was possible to affect simultaneous base editing of PCSK9 and ANGPTL3 with a single test article, LNPs were formulated containing a mix of three components: ABE8.8 mRNA, PCSK9-targeting gRNA (GA095), and ANGPTL3-targeting gRNA (GA098) at a 2:1:1 weight ratio. Primary human hepatocytes were incubated with various dilutions of the LNPs. Three days after incubation, genomic DNA was harvested from the hepatocytes, and then assessed for base editing of the target splice site with next-generation sequencing. At the highest LNP concentrations, ≈40% editing of the PCSK9 splice site (intron 1 splice donor) and ≈40% editing of the ANGPTL3 splice site (intron 6 splice donor) was observed (FIG. 42), demonstrating the feasibility of dual gene disruption in human hepatocytes with a single test article and providing a preclinical proof of concept of a single base-editing therapy simultaneously knocking down PCSK9 and ANGPTL3, which would be predicted to substantially reduce both blood LDL cholesterol levels and blood triglyceride levels in human recipients. An advantage of this approach is that because the base editors do not require double strand breaks (DSBs) for editing, in contrast to standard CRISPR-Cas9, there is substantially lower risk of chromosomal rearrangements or other structural changes inherent in the simultaneous targeting of two different sites in the genome.

Figure 43:
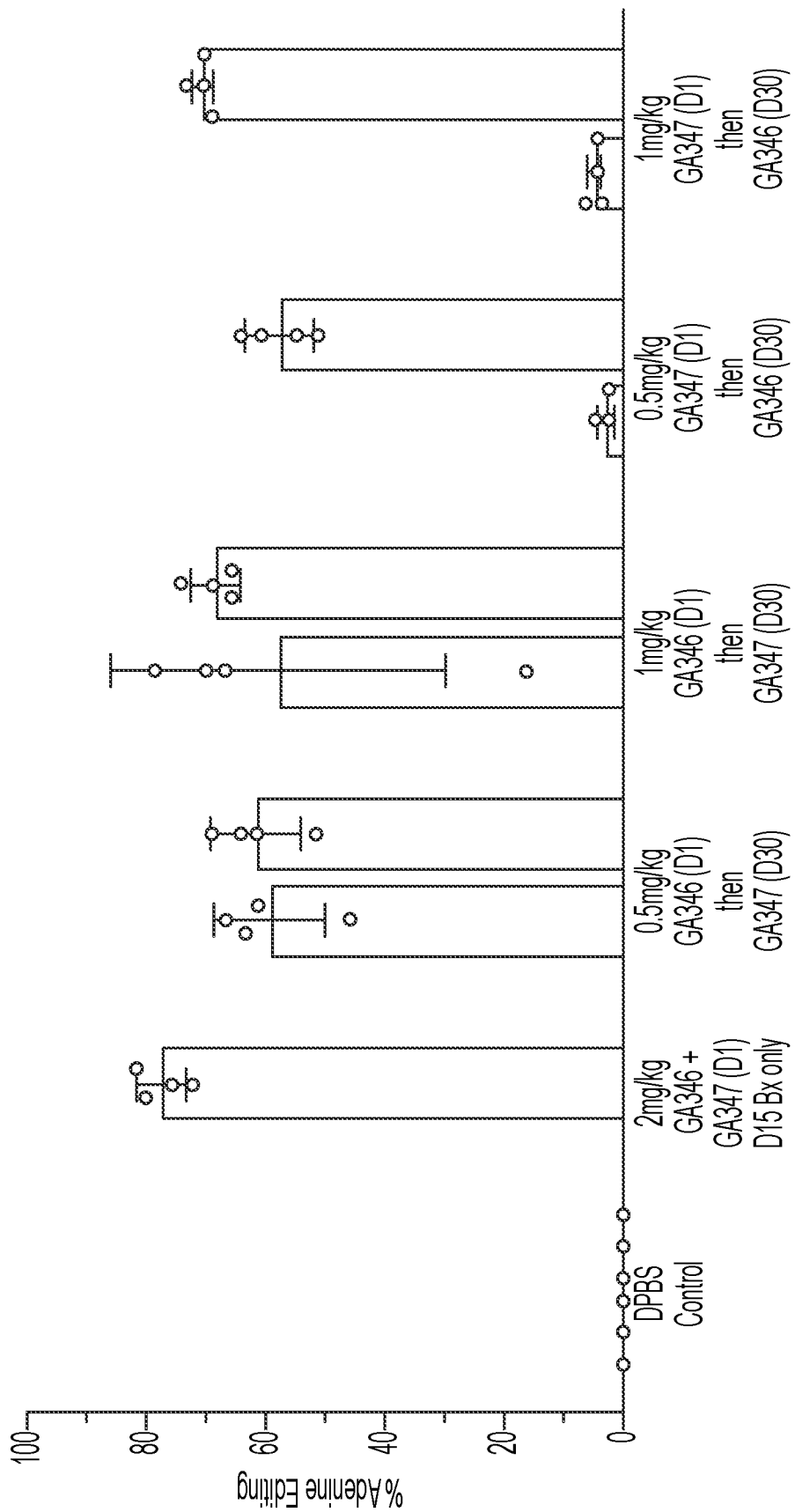
FIG. 43 shows Day 15 and Day 44 liver biopsy adenosine base editing results. NHPs were dosed with LNPs formulated with ABE8.8 mRNA MA004 and either a gRNA targeting PCSK9 (GA346) or a gRNA targeting ANGPTL3 (GA347) via intravenous infusion at a total RNA doses ranging from 0.5-2 mg/kg. Two weeks after administration of test article, biopsies were performed to assess base editing. After 30 days from the initiation of the study, the opposite LNP was administered. Following a second biopsy after an additional 2 weeks, the gDNA was extracted, and base editing was assessed using next generation sequencing. Results for PCSK9 base editing (top panel) and ANGPTL3 base editing (bottom panel) are shown. 2 mg/kg total RNA dose of LNP encapsulating ABE8.8 mRNA, PCSK9 gRNA GA346 and ANGPTL3 gRNA GA347 at 1:0.5:0.5 weight ratio produced robust synchronized PCSK9 and ANGPTL3 gene editing (Example 10).
Figure 43:
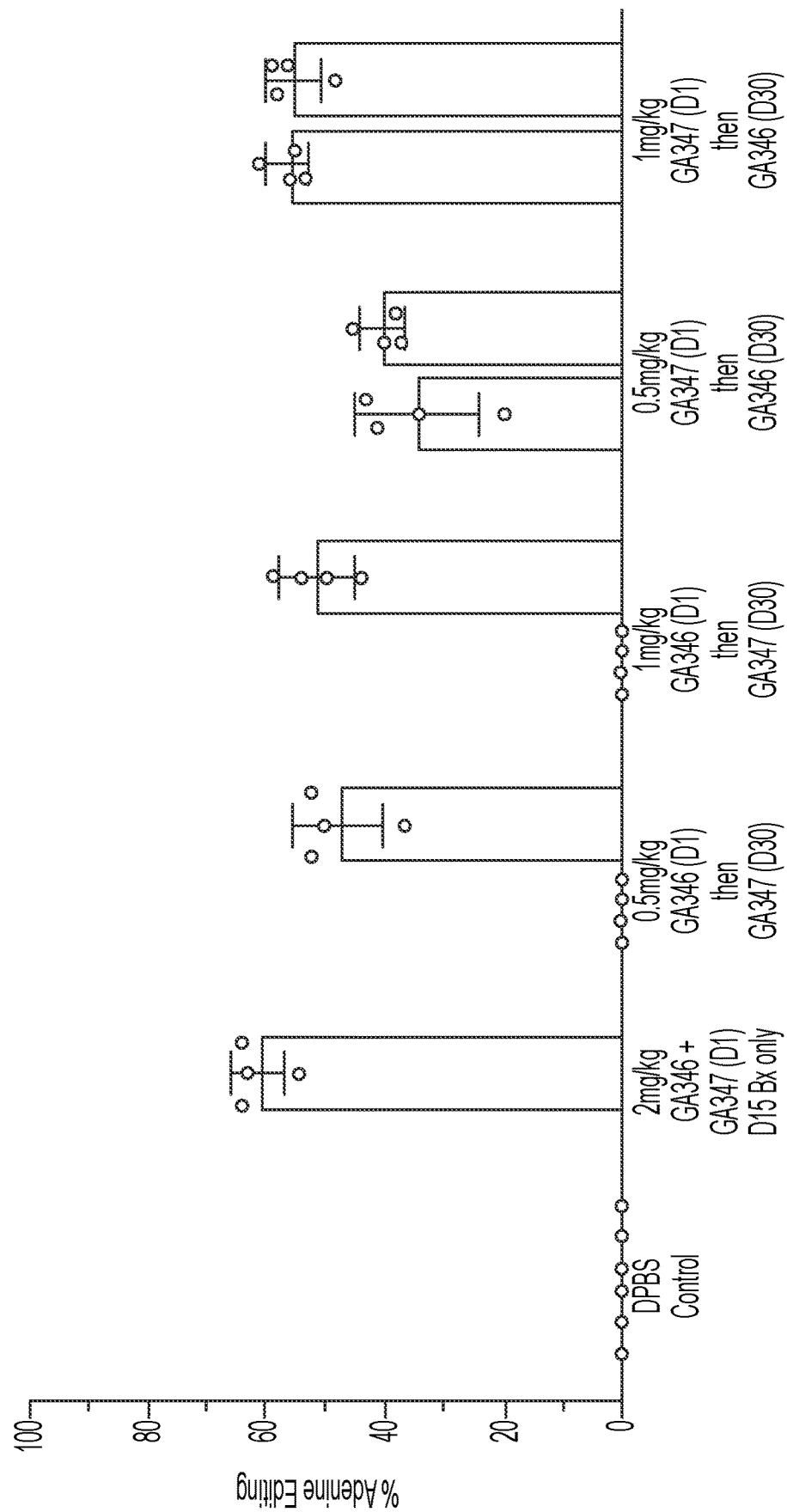
Figure 44:
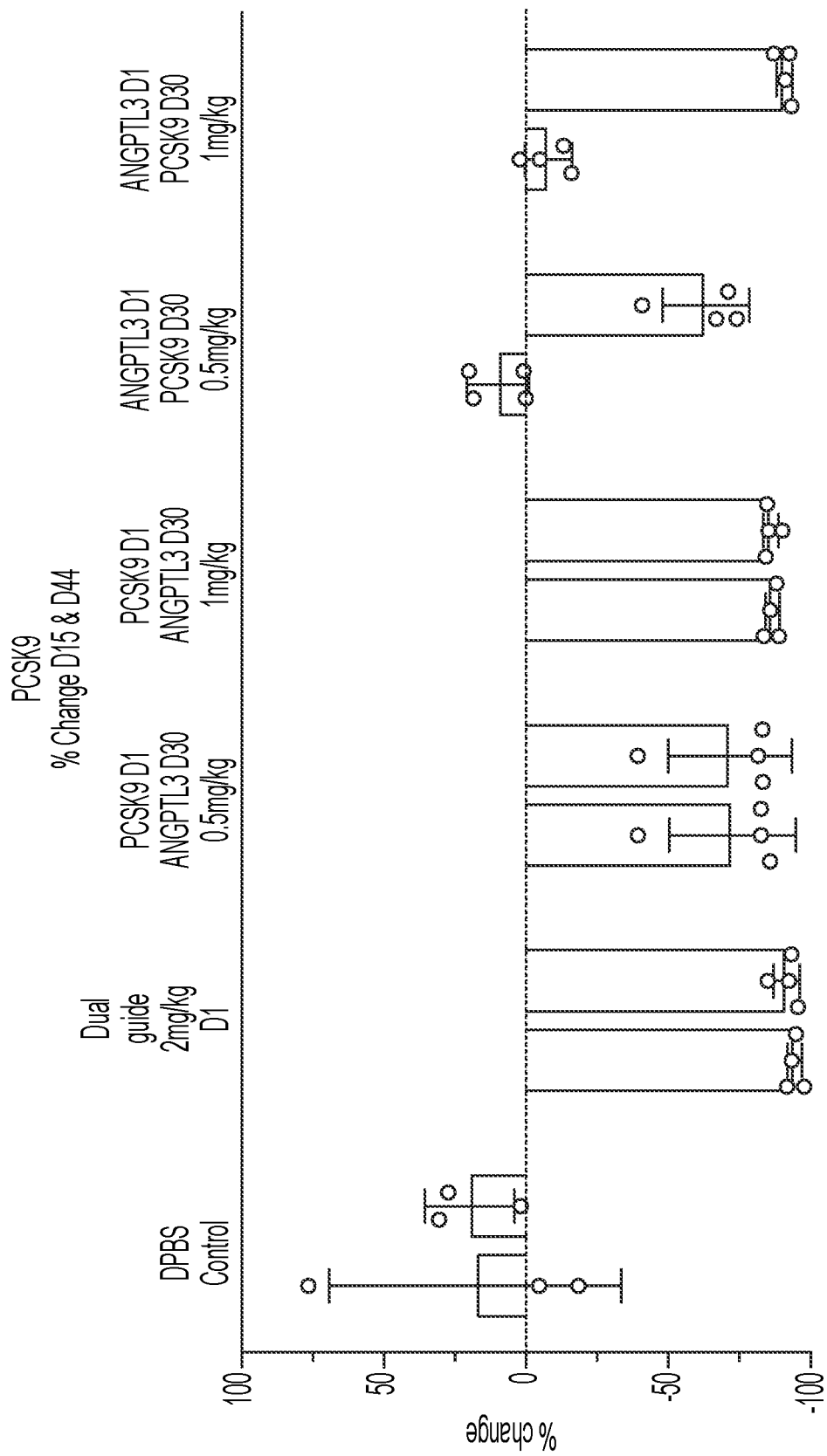
FIG. 44 illustrates the corresponding % change in PCSK9 (top panel) and ANGPTL3 (bottom panel) protein levels from NHPs described in FIG. 43.
Figure 44:
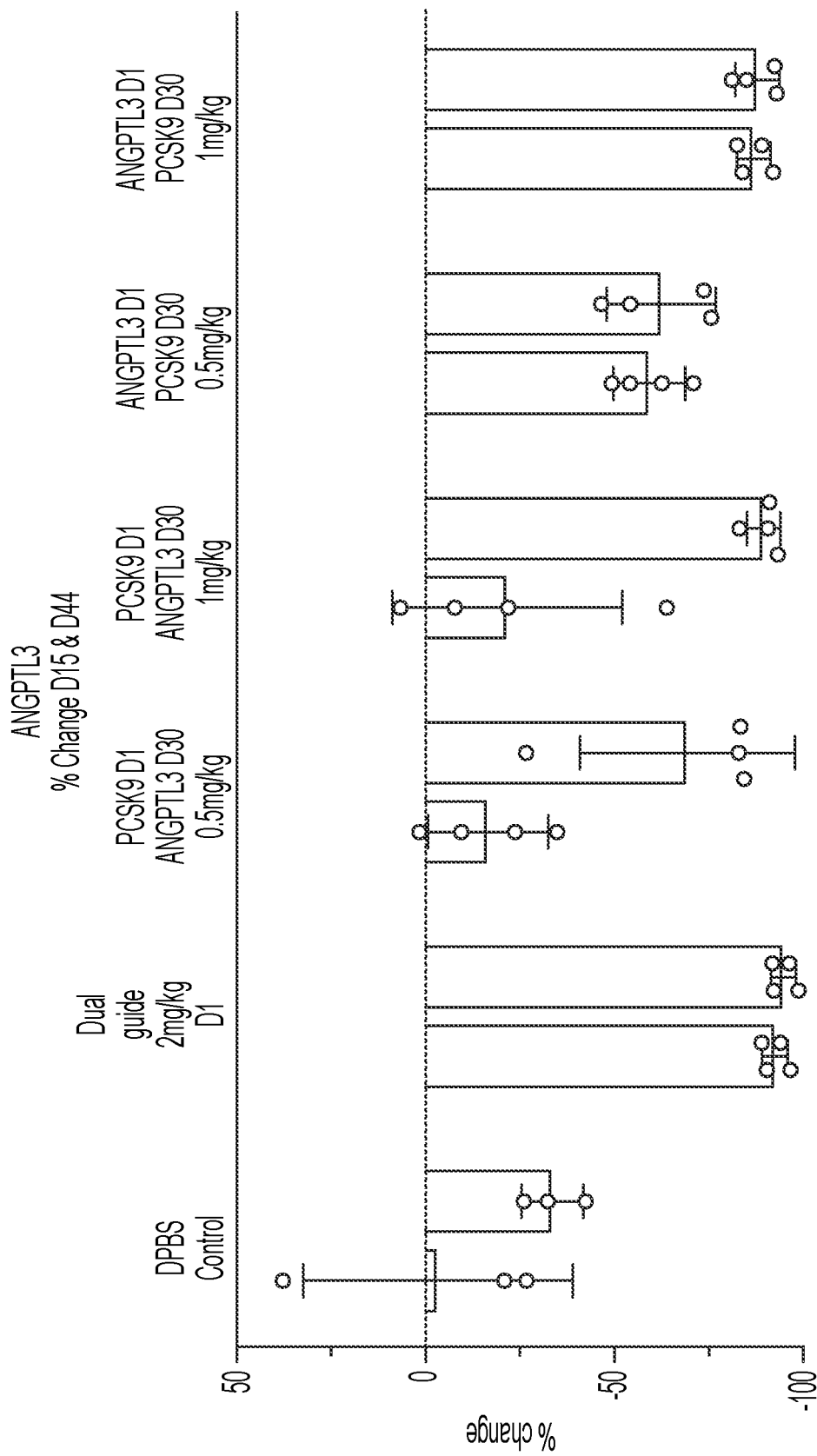

A follow-up NHP study was performed to address: 1) if a second dose of administered LNPs administered can cause editing of the target gene; 2) if a different target can be base edited. LNPs formulated with ABE8.8 mRNA and either a gRNA targeting PCSK9 (GA346) or a gRNA targeting ANGPTL3 (GA347) was administered to cynomolgus monkeys via intravenous infusion at doses ranging from 0.5-2 mg/kg. Two weeks after administration of test article, biopsies were performed to assess for base editing. After 30 days from the initiation of the study, the opposite LNP was administered. Following a second biopsy after an additional 2 weeks, the gDNA was extracted, and base editing was assessed using next generation sequencing. The findings from this study show that high level editing of both the PCSK9 and ANGPTL3 targets are achieved after the first and second doses of LNPs (FIG. 43). Blood samples were collected on both biopsy timepoints and show significant decrease of around 90% in circulating PCSK9 and ANGPTL3 after subsequent dosing with 1 mg/kg LNPs (FIG. 44). In the same study an LNP encapsulating ABE8.8 mRNA, PCSK9 gRNA GA346 and ANGPTL3 gRNA GA347 at 1:0.5:0.5 weight ratio was adminstered at 2 mg/kg total RNA dose, which resulted in robust synchronized PCSK9 and ANGPTL3 gene editing (FIG. 44, top and bottom data labelled GA346+GA347 (D1)— top and bottom panels show PSCK9 and ANGPTL3 editing). The data demonstrate that robust multi-gene editing is possible with single 1-dose administration of ABE base editor mRNA and two or more gRNAs targeting two or more genes of interest in mammals (and/or mammalian cell). FIG. 44 mirrors corresponding knockdown of ANGPTL3 (bottom) and PCSK9 (top) proteins.

Figure 45:
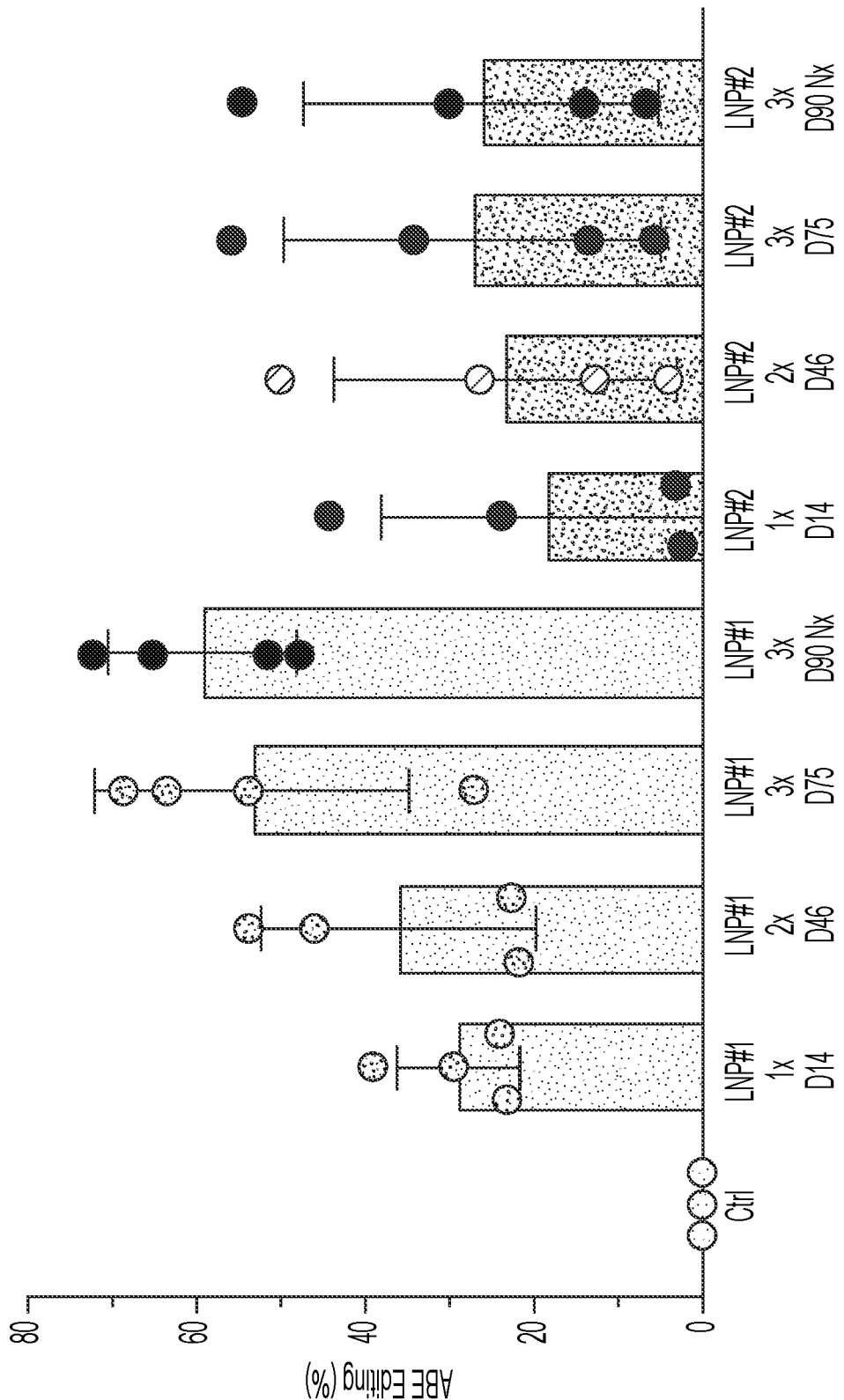
FIG. 45 illustrates that repeat LNP dosing in NHPs causes additive adenosine base editing in the liver, post Day 14, Day 46, and Day 75 liver biopsies. NHPs were dosed with either LNP #1 or LNP #2 formulated with ABE8.8 mRNA MA004 and a gRNA targeting PCSK9 (GA097) via intravenous infusion at a total RNA doses of 0.5 mg/kg (see Example 10 for details on dosing intervals and related details).

In another study, NHPs were repeat dosed with LNPs (FIG. 45). NHPs were dosed with LNP #1 and LNP #2 formulated with ABE8.8 mRNA MA004 and a gRNA targeting PCSK9 (GA097) via intravenous infusion at a total RNA doses of 0.5 mg/kg. NHPs received an additional LNP dose on day 30 and on day 60. Liver biopsies from Day 14, Day 46, and Day 75 were extracted for adenosine base editing analysis. All gDNA was extracted, and base editing was assessed using next generation sequencing. These results demonstrate that repeat dosing of LNP containing ABE8.8 mRNA and PCSK9 gRNA causes additive base editing in the liver, as editing efficiency was near 30% after the first dose of LNP, while over 50% after the third dose LNP. It was also observed that the magnitude of additive editing was LNP-dependent.

Figure 46:
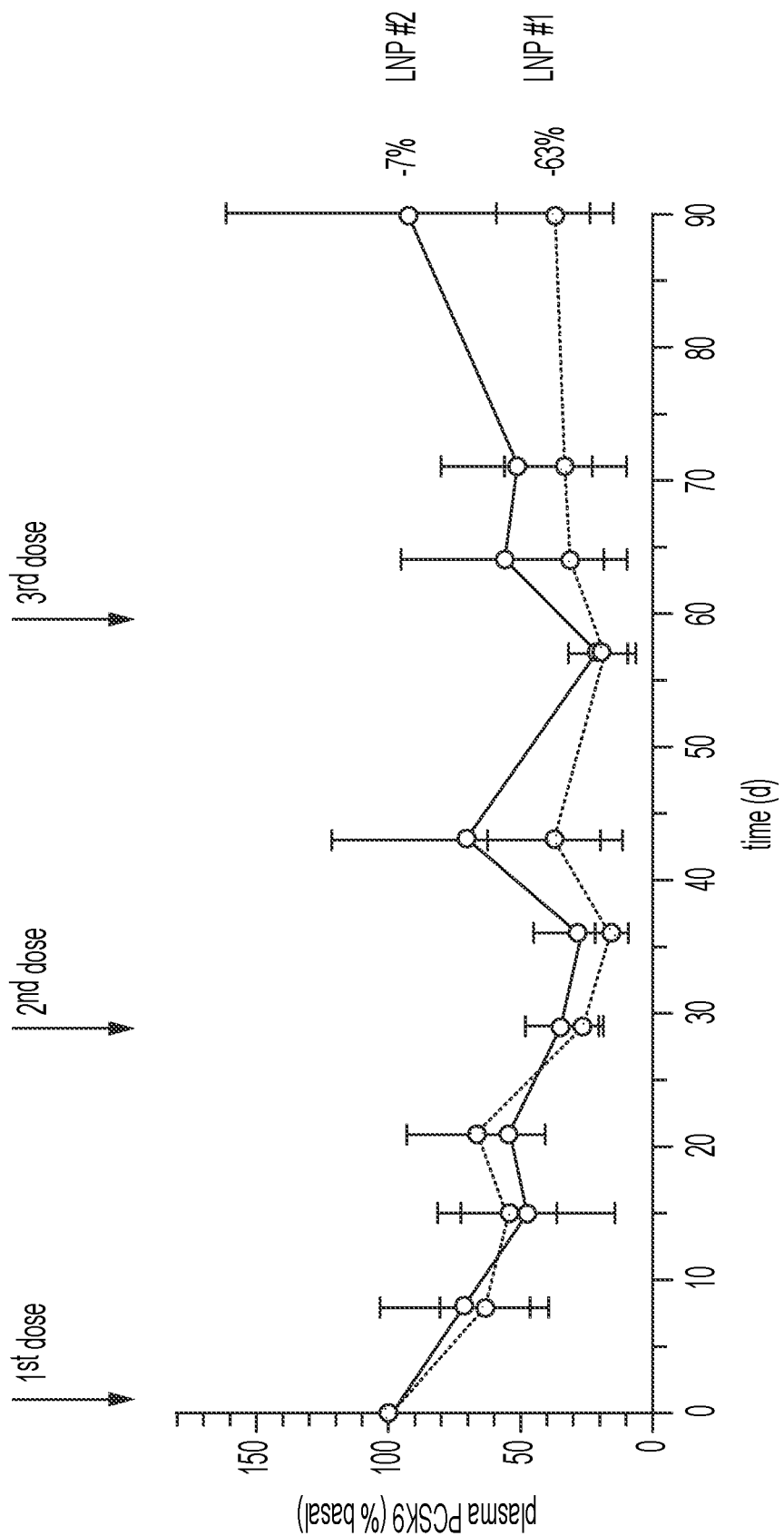
FIG. 46 illustrates that repeat LNP dosing in NHPs causes additive base editing in the liver and translates to dose-dependent additive decrease in plasma PCSK9 protein levels over 90 days. As described in FIG. 45, NHPs were repeat dosed with LNPs formulated with ABE8.8 mRNA MA004 and a gRNA targeting PCSK9 (GA097). NHPs were dosed via intravenous infusion at a total RNA doses of 0.5 mg/kg at days 0, 30, and 60 (arrow is illustrated on graph to depict dosing). For description of analysis of PCSK9 protein levels, see detailed methods section.

Further, repeat dosing of LNPs reduced PCSK9 protein levels in NHPs (FIG. 46). The PCSK9 protein levels were monitored over 90 days in NHPs that were repeat dosed with LNPs formulated with ABE8.8 mRNA MA004 and a gRNA targeting PCSK9 (GA097). NHPs were dosed via intravenous infusion at a total RNA dose of 0.5 mg/kg at days 0, 30, and 60 (arrow is illustrated on graph to depict dosing). For description of analysis of PCSK9 protein levels, see detailed methods section. Compared to basal levels, PCSK9 protein dropped by nearly 40% after the initial dose of LNP, but upon additional doses, decreased even further.

Figure 47:
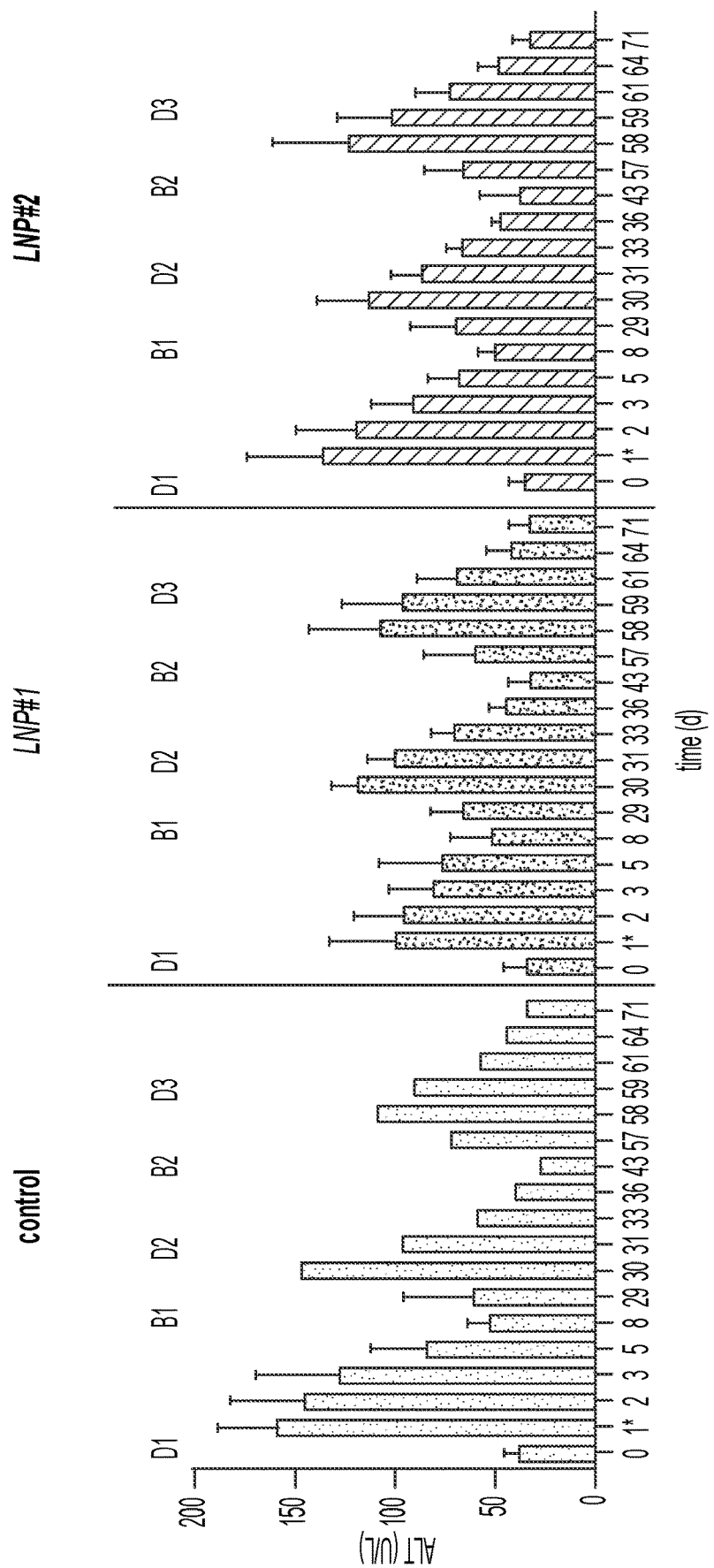
FIG. 47 illustrates that repeat LNP dosing in NHPs causes additive base editing in the liver with only transient liver marker increase, and the transient liver marker increase correlates well with the day of each dose administered. The data shows 71 days of the liver marker levels of ALT, AST, total bilirubin, and creatine kinase post first dose (see Example 10, FIG. 45 for details).
Figure 47:
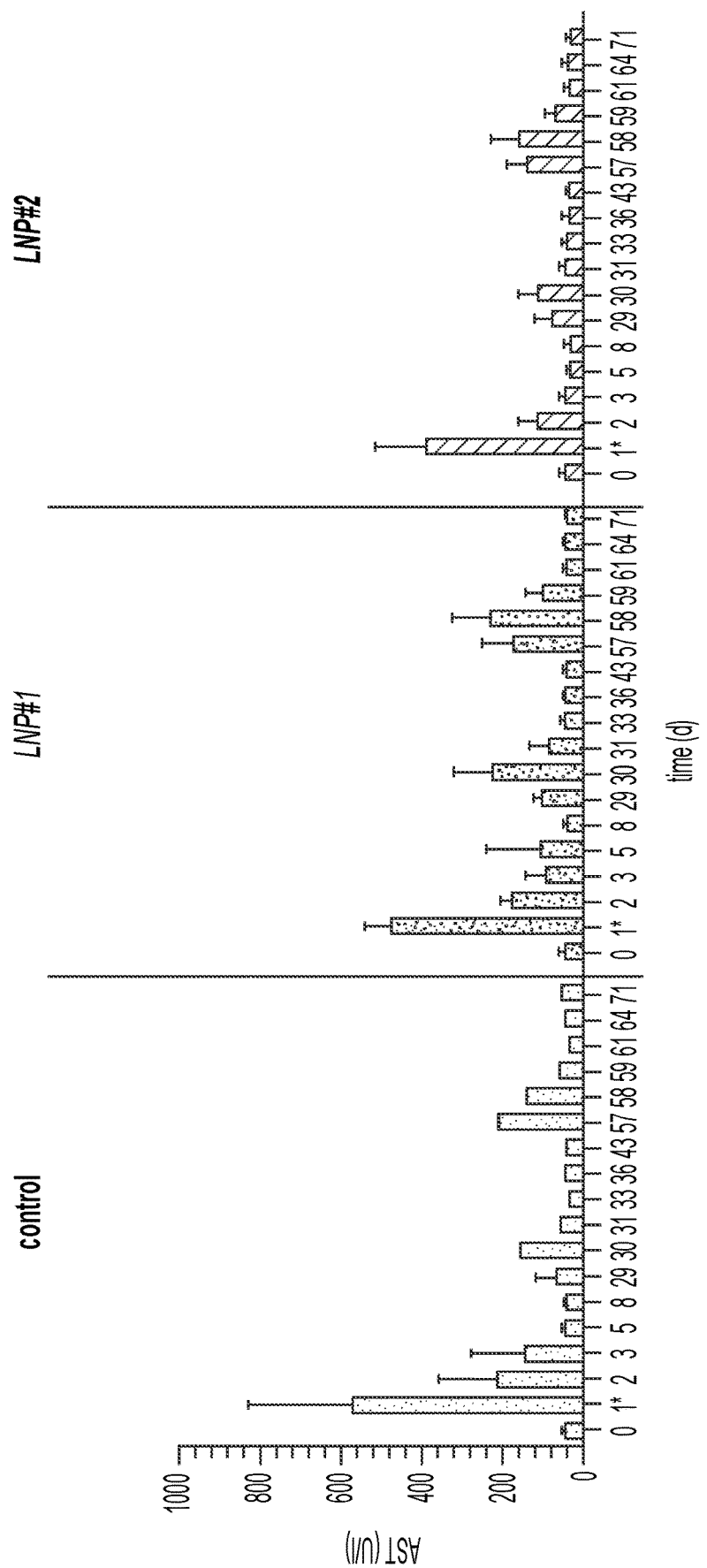
Figure 47:
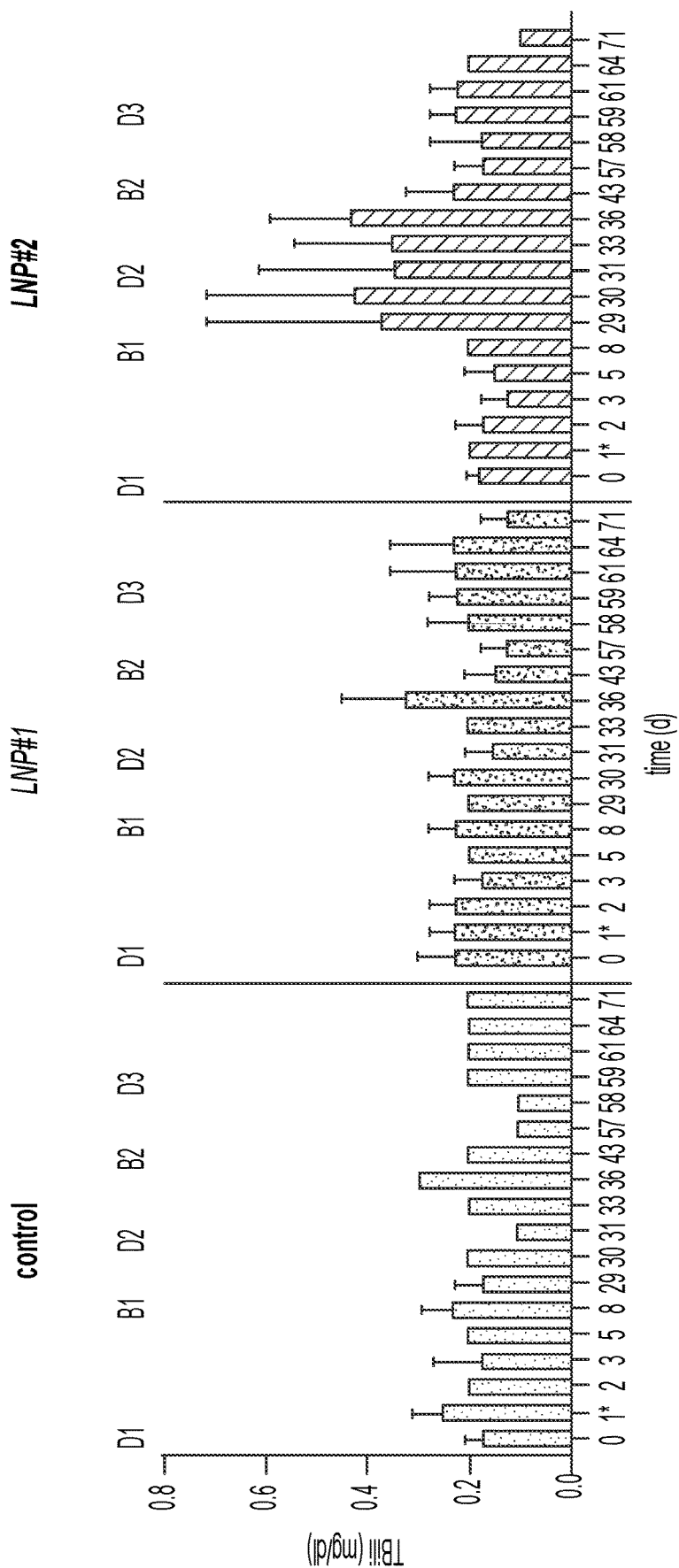
Figure 47:
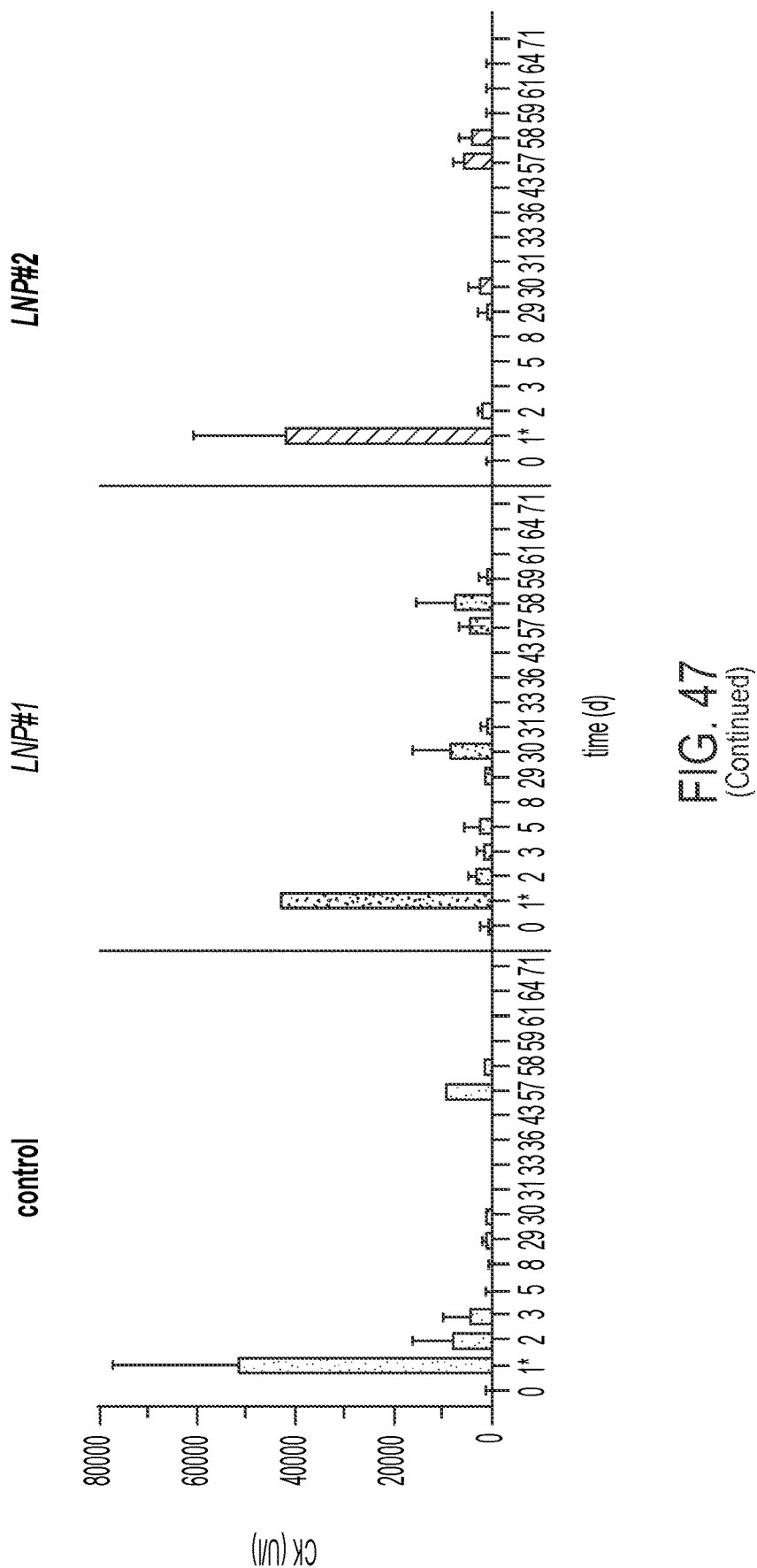

Liver markers were assessed following repeat dosing of LNPs (FIG. 47). ALT, AST, total bilirubin, and creatine kinase levels were assessed up to 71 days in NHPs that were repeat dosed with LNPs formulated with ABE8.8 mRNA MA004 and a gRNA targeting PCSK9 (GA097). NHPs were dosed via intravenous infusion at a total RNA dose of 0.5 mg/kg at days 0, 30, and 60, which is shown as D1, D2 and D3 on graph, respectively. Liver biopsy was performed at days 14 and 46 which is shown as B1 and B2 on graph, respectively. Blood was collected at multiple timepoints, as described on the graph. Although ALT and AST minimally rose upon dosing, this was a transient response that returned to normal after a period of several days. Similarly, Creatine Kinase levels increased upon dosing, with the largest effect seen after the first dose, and returned to basal levels after a period of several days.

Figure 48:
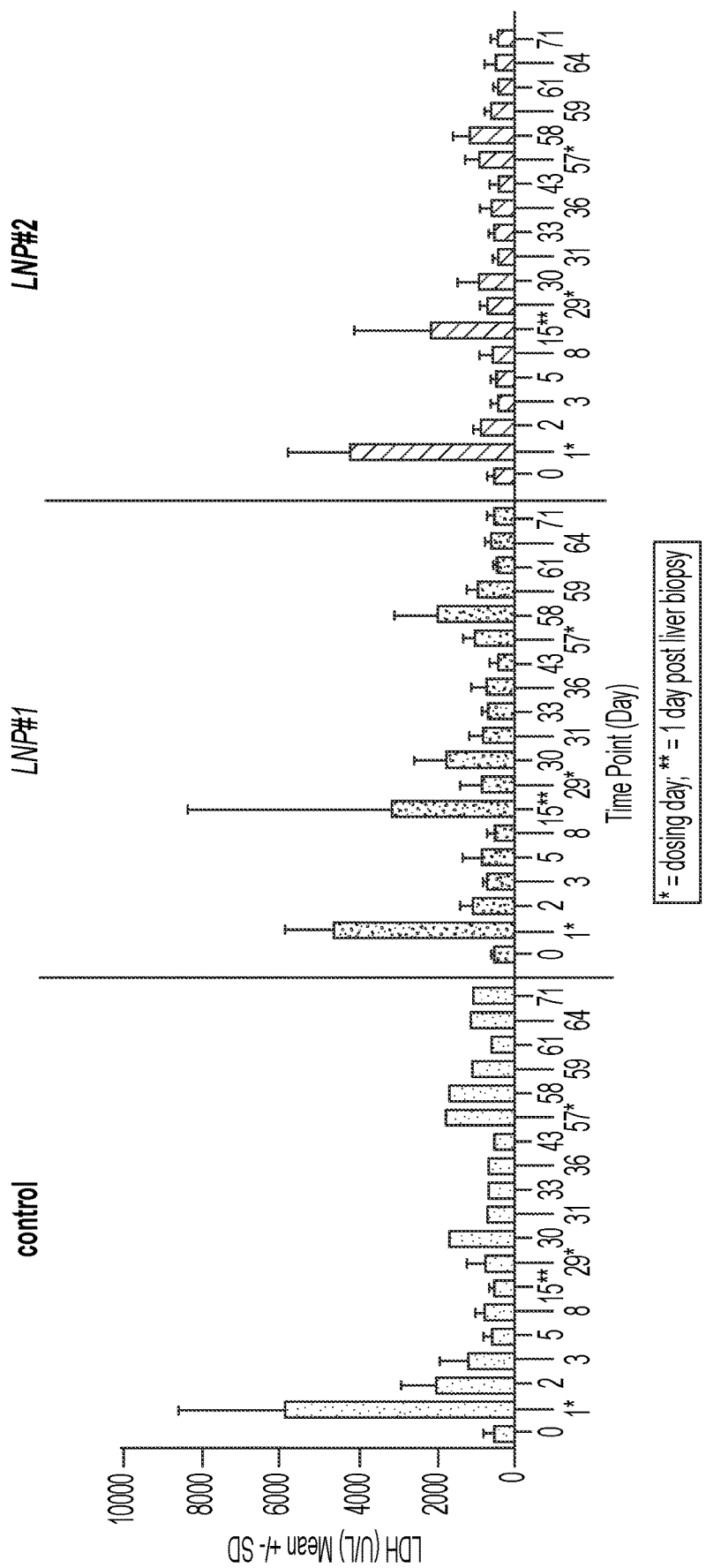
FIG. 48 illustrates that repeat LNP dosing in NHPs causes additive base editing in the liver, with only transient liver marker increase showing up to 71 days post dose of the liver enzyme levels of LDH, GLDH, GGT, and ALP, in NHPs (See Example 10, FIG. 45 for details).
Figure 48:
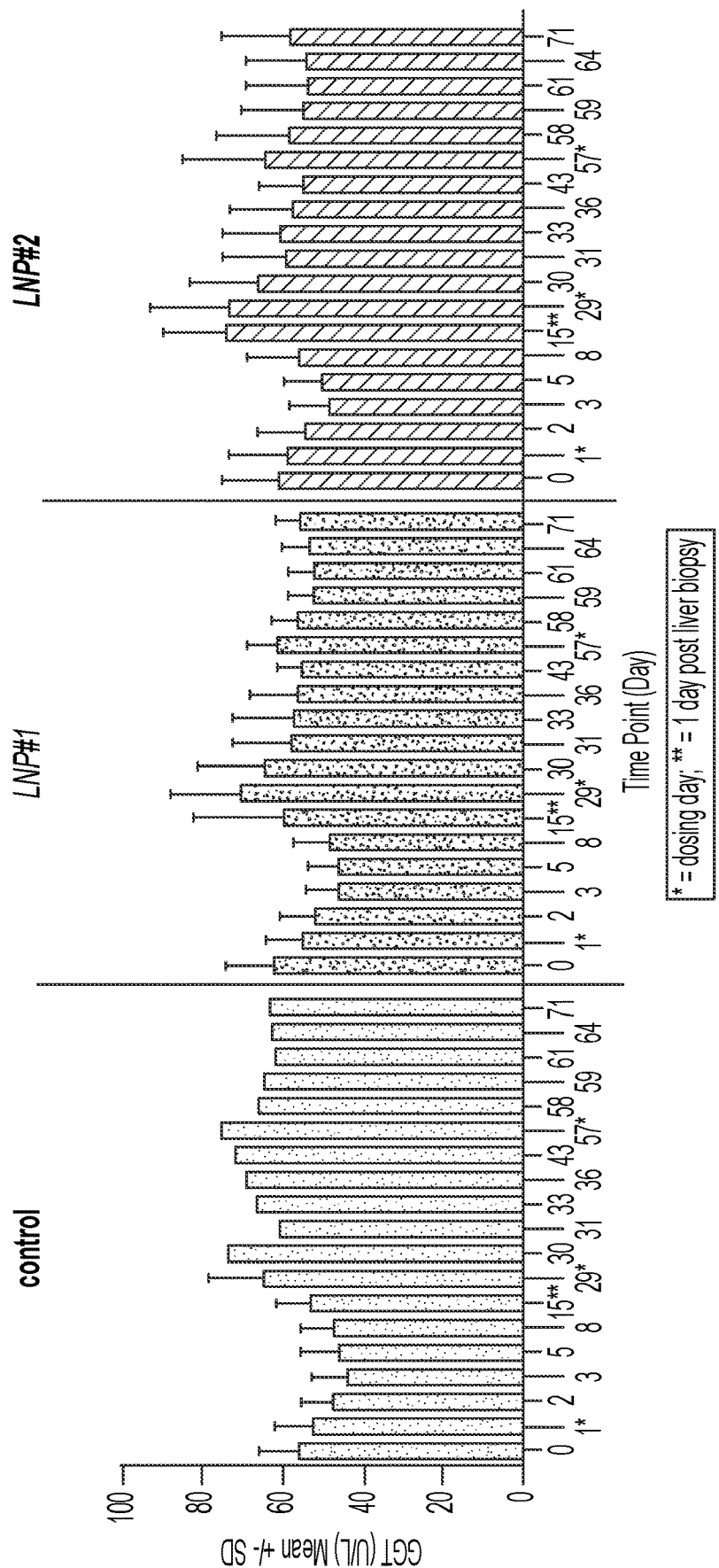
Figure 48:
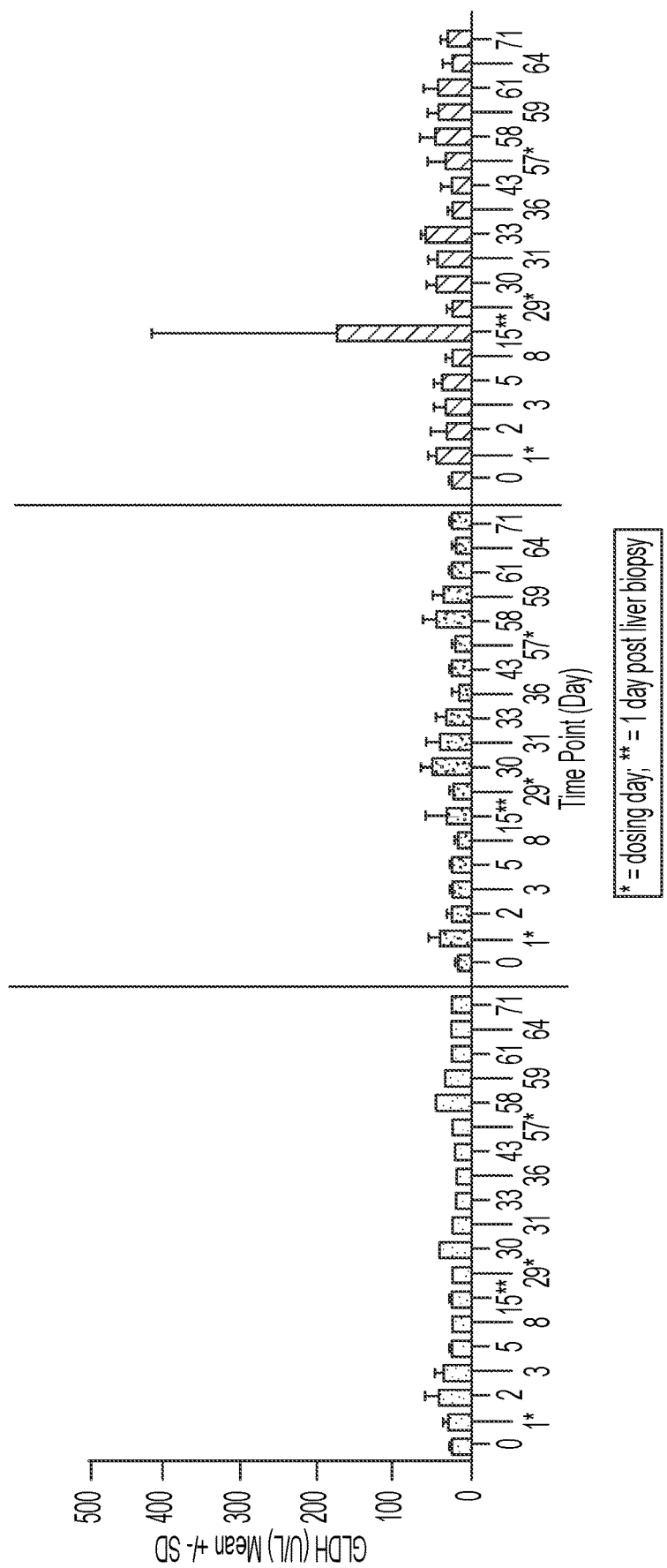
Figure 48:
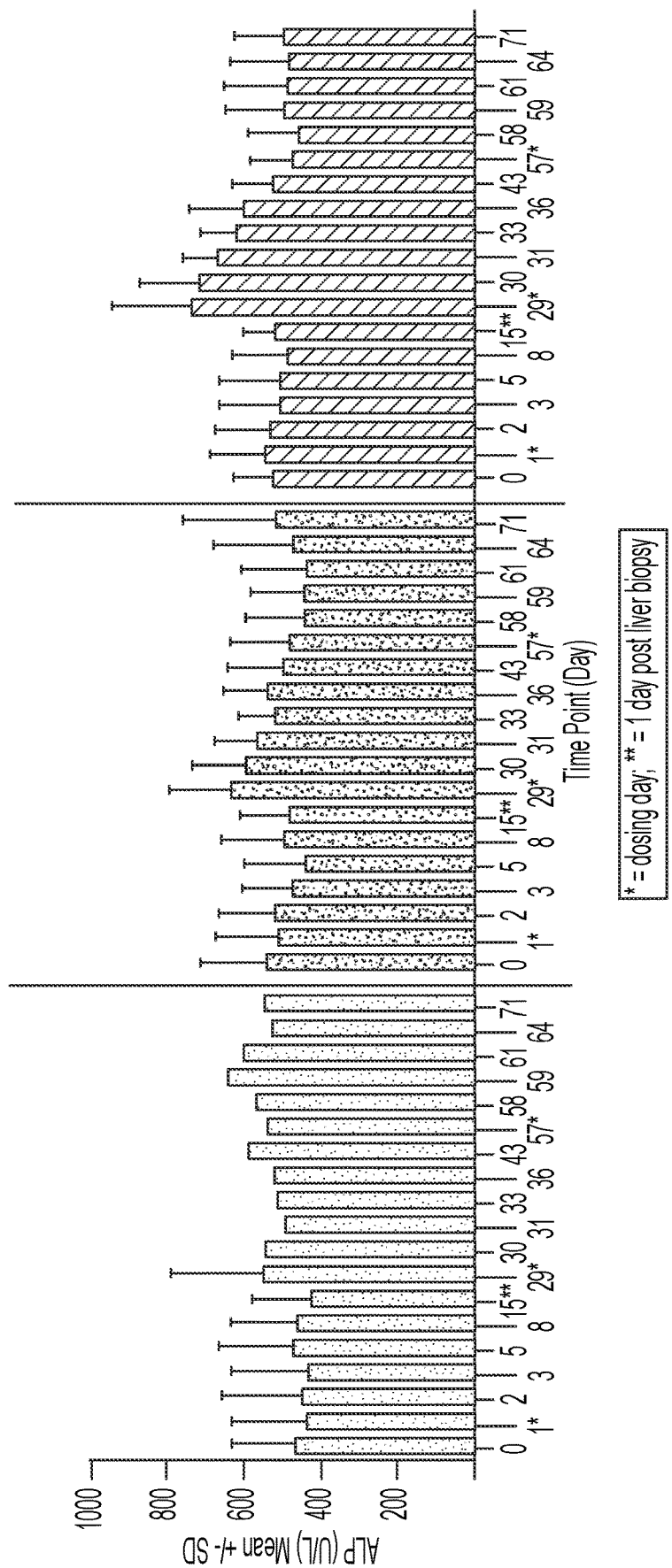

The liver enzymes, LDH, GLDH, GGT, and ALP, were assessed in NHPs that were repeat dosed with LNPs formulated with ABE8.8 mRNA MA004 and a gRNA targeting PCSK9 (GA097) (FIG. 48). NHPs were dosed via intravenous infusion at a total RNA doses of 0.5 mg/kg at days 0, 30, and 60. Blood was collected at multiple timepoints, as described on the graph. Although LDH and GLDH rose upon dosing, this was a transient response that returned to normal after a period of several days.

Figure 49A:
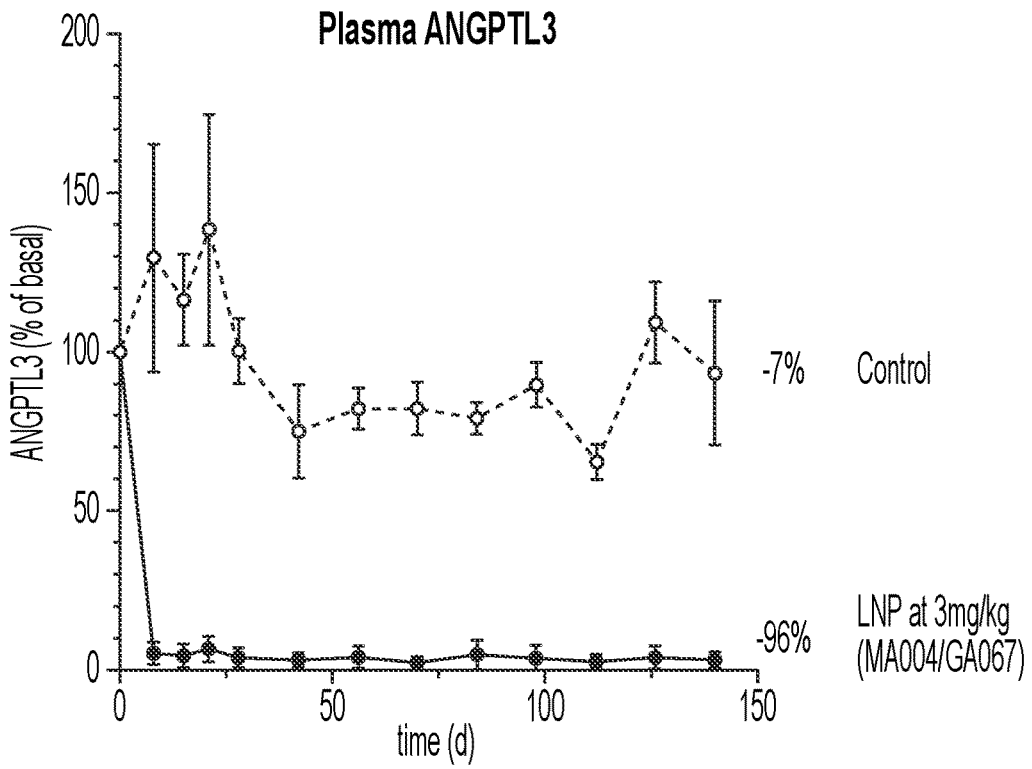
FIGS. 49A and 49B illustrate that base editing of ANGPTL3 results in long-term decreased ANGPTL3 protein and triglyceride levels after a single dose of LNP constituted with ABE8.8 mRNA MA004 and ANGPTL3 gRNA GA067. The results illustrates the effect of long-term adenine base editing of ANGPTL3 on ANGPTL3 protein (FIG. 49A) and triglycerides (FIG. 49B) in non-human primates over 6 months. ANGPTL3 protein (96% reduction) and triglyceride levels were substantially decreased upon single dose administration of the LNP, and remain stably reduced for more than 170 days (see Example 10 for details).
Figure 49B:
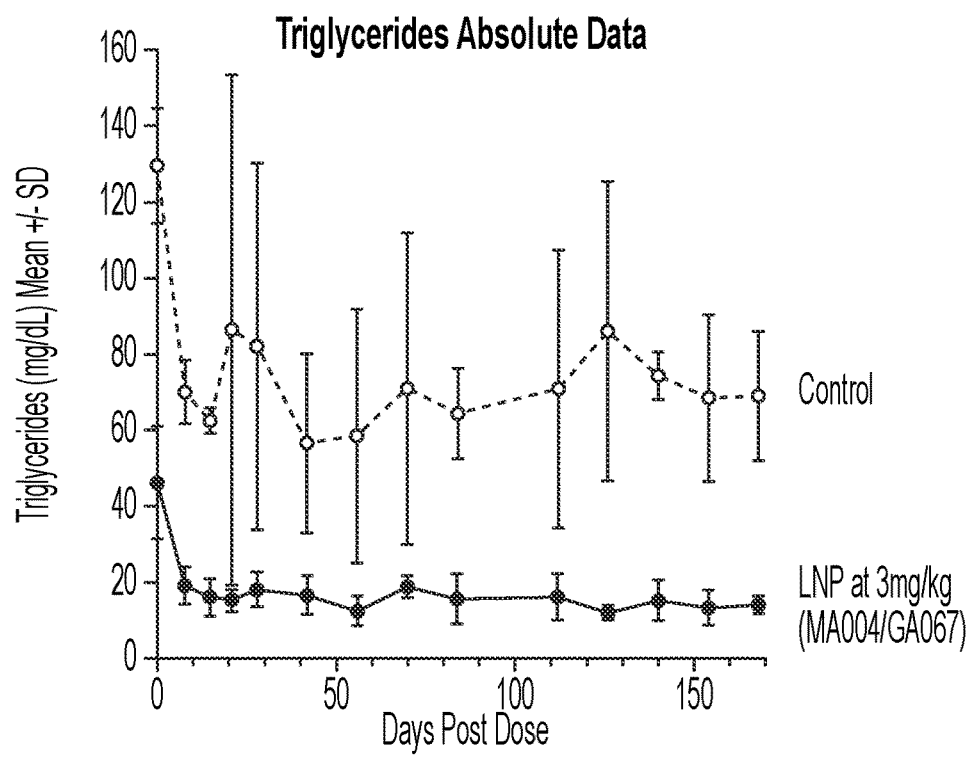

Further, long-term adenine base editing of ANGPTL3 was assessed in non-human primates (FIG. 49). Cynomolgus monkeys received an intravenous infusion of a 3 mg/kg dose of an LNP formulation with ABE8.8 mRNA MA004 and ANGPTL3 gRNA GA067. Blood was collected at timepoints specified and the graph, and ANGPTL3 protein levels (FIG. 49A) and triglyceride levels (FIG. 49B) were analyzed. As compared to controls, both ANGPTL3 protein levels (96% reduction) and triglyceride levels substantially decreased upon base editing of the gene, and remain stably reduced for more than 170 days.

Figure 50A:
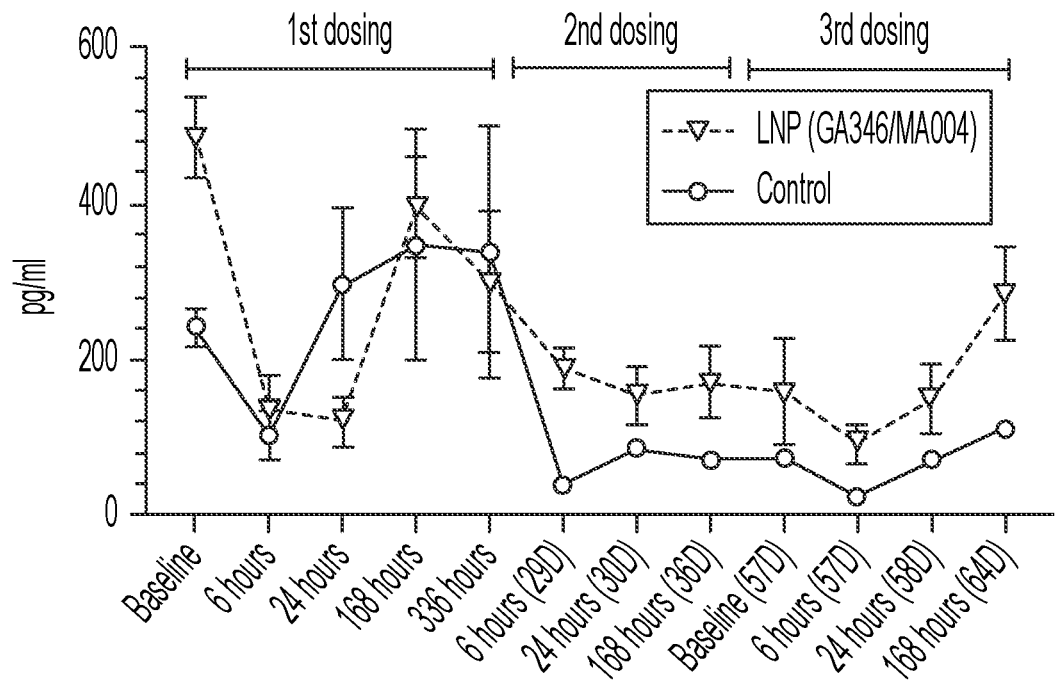
FIGS. 50A-50E illustrate the effect of LNP dosing in NHPs on cytokine activation and immune response. Cynomolgus monkeys received intravenous infusions of 0.5 mg/kg doses at specified time points (FIG. 50A and FIG. 50B) of an LNP formulation with ABE8.8 mRNA MA004 and PCSK9 gRNA GA346. Blood was collected at time-points specified and the graph, and IP-10 and MCP-1 were analyzed. In additional studies, IL-6, MCP-1, and SC5b-9 (FIG. 50C, FIG. 50D, and FIG. 50E, respectively) were analyzed at different time points from blood collected from NHPs that received an intravenous infusion of 1.0 mg/kg total RNA dose of LNP formulated with MA004 and PCSK9 gRNA GA346.
Figure 50B:
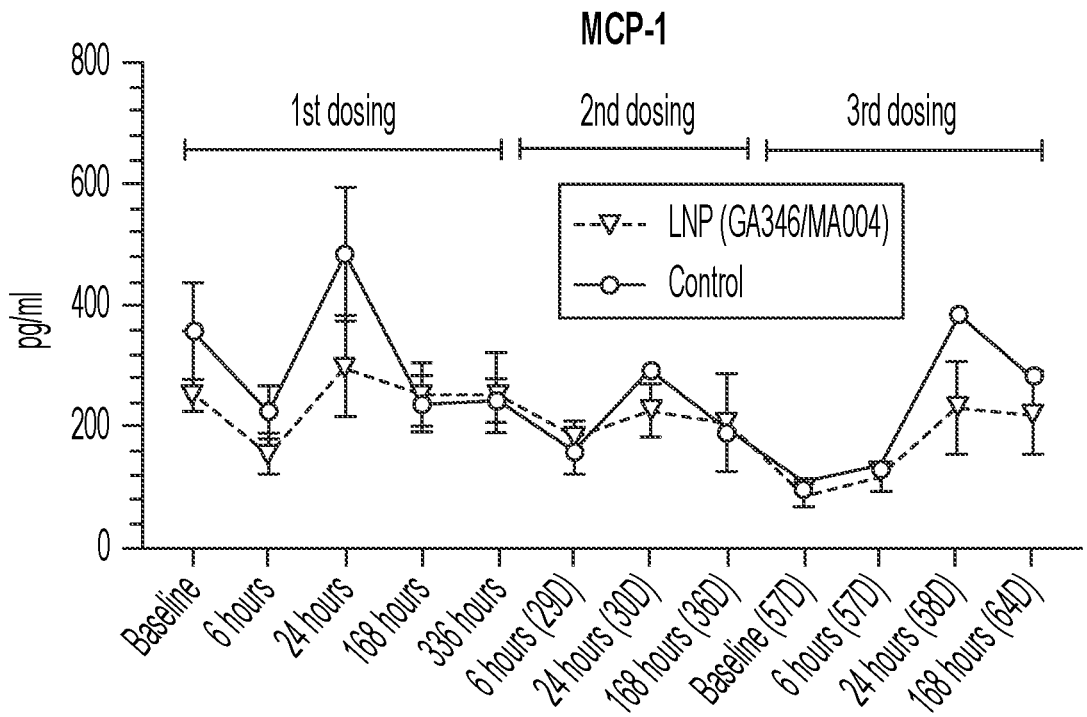

Cytokine activation and immune response were assessed in NHPs receiving LNPs. In one set of studies, cynomolgus monkeys received intravenous infusions of 0.5 mg/kg doses at three specified time points (FIG. 50A and FIG. 50B) of an LNP formulation with ABE8.8 mRNA MA004 and PCSK9 gRNA GA346. Blood was collected at timepoints specified and the graph, and IP-10 and MCP-1 were analyzed. These results demonstrated: 1) that NHPs receiving LNPs had no evidence of cytokine activation nor immune response, as compared to control; and 2) that repeat dosing of the same LNP does not elicit cytokine activation nor an immune response.

Figure 50C:
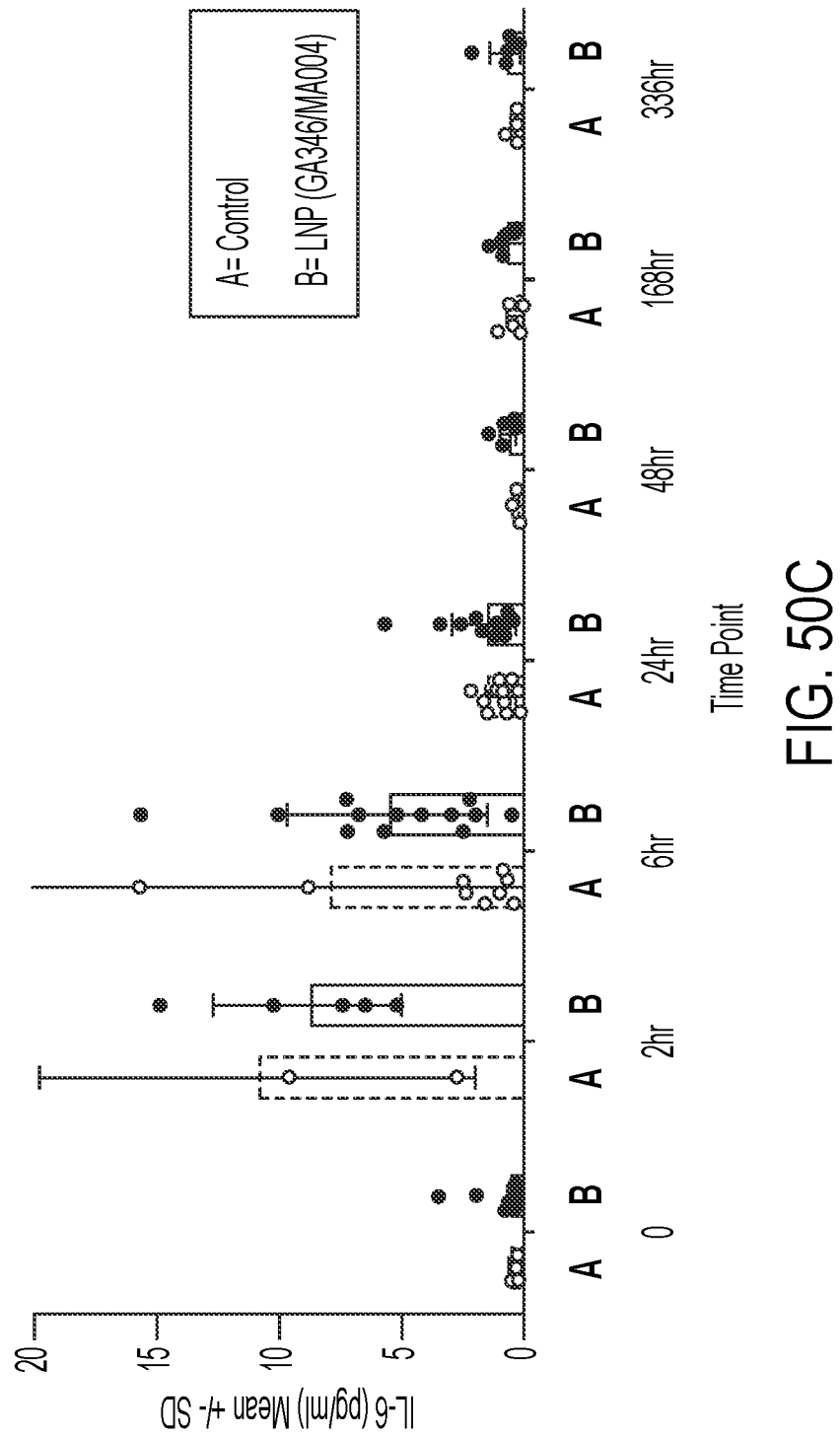
Figure 50D:
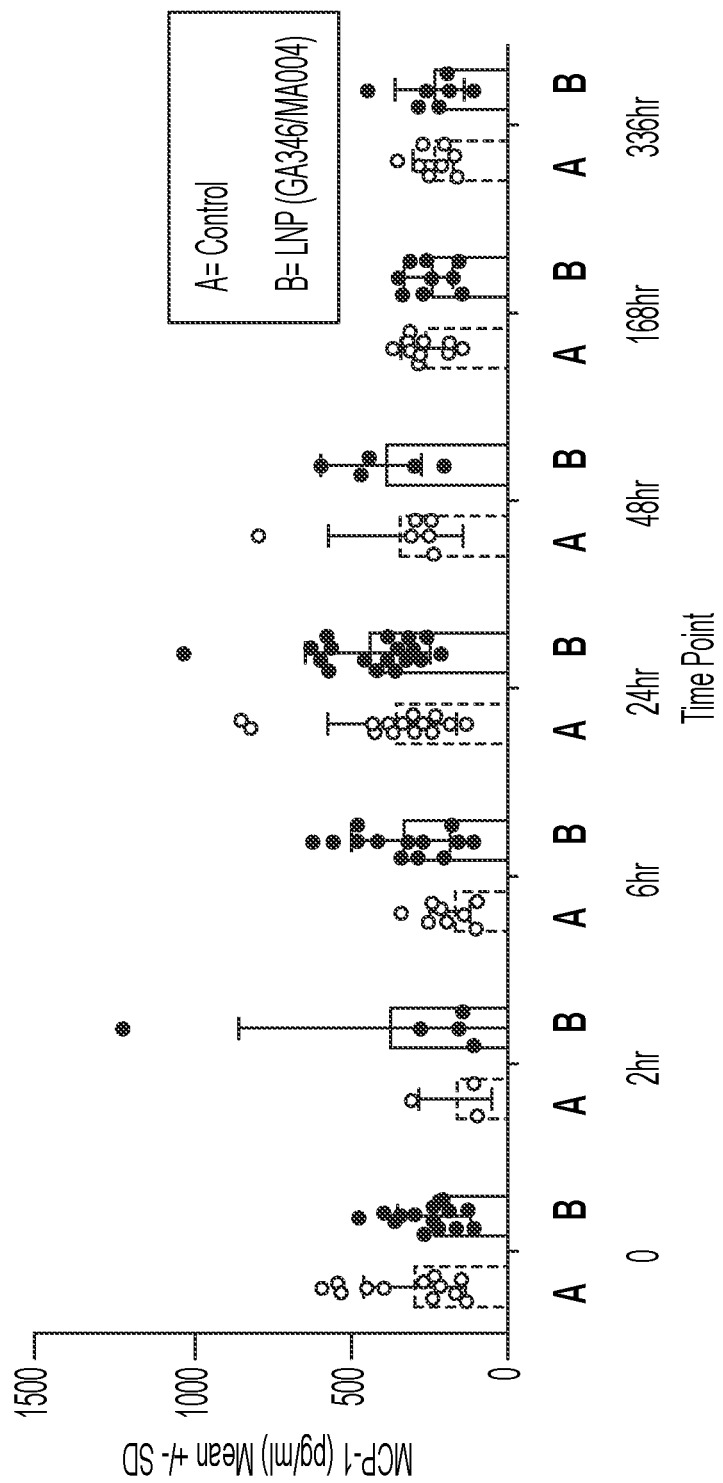
Figure 50E:
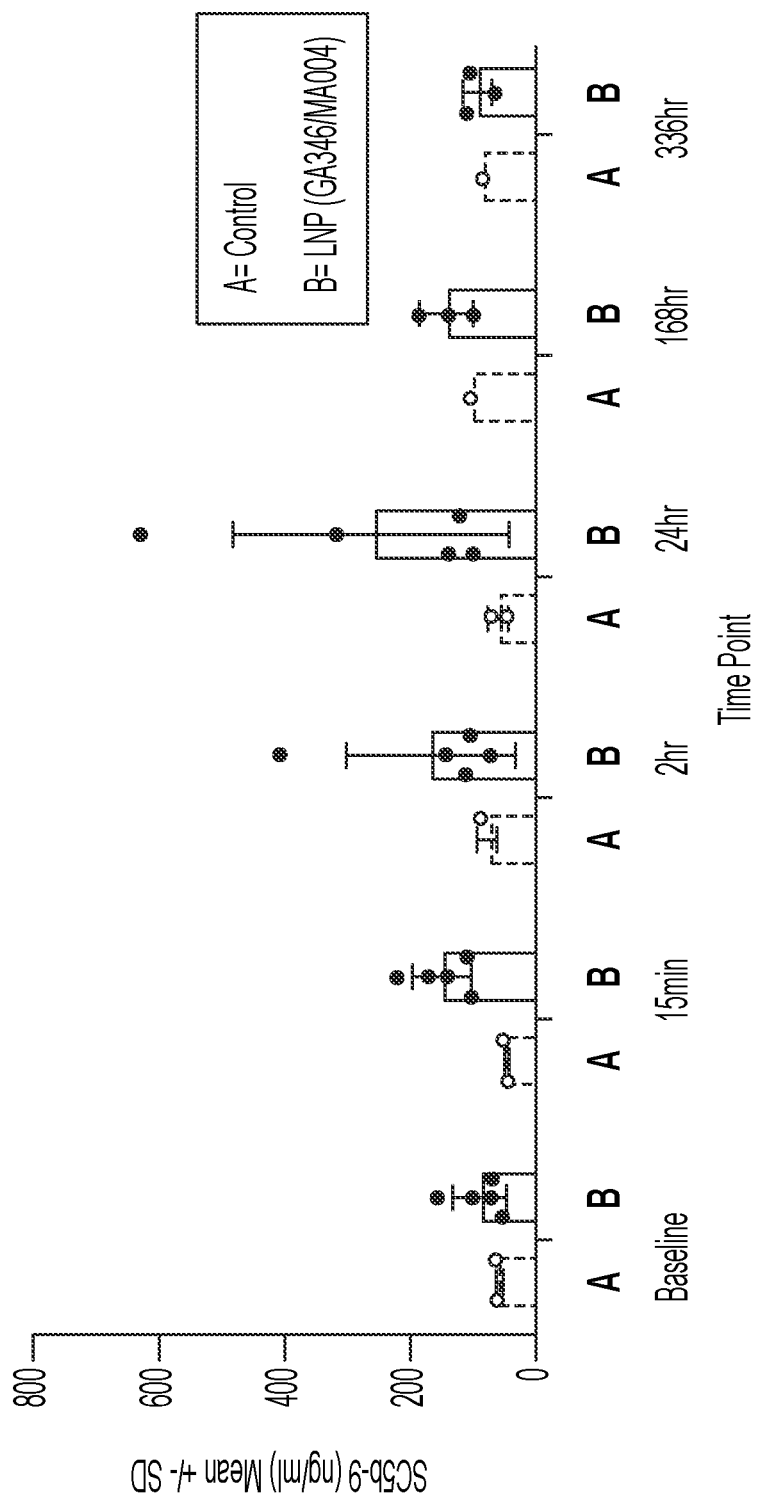

In additional studies, TL-6, MCP-1, and SC5b-9 (FIG. 50C, FIG. 50D, and FIG. 50E, respectively) were analyzed at different time points from blood collected from NHPs that received an intravenous infusion of 1.0 mg/kg total RNA dose of LNP formulated with MA004 and PCSK9 gRNA GA346. This caused minimal cytokine/complement activation that returned to baseline by/before 336 hours, as compared to control.

Example 11. Evaluation of SpCa9-Mediated On-Target Editing Efficiency

Figure 51:
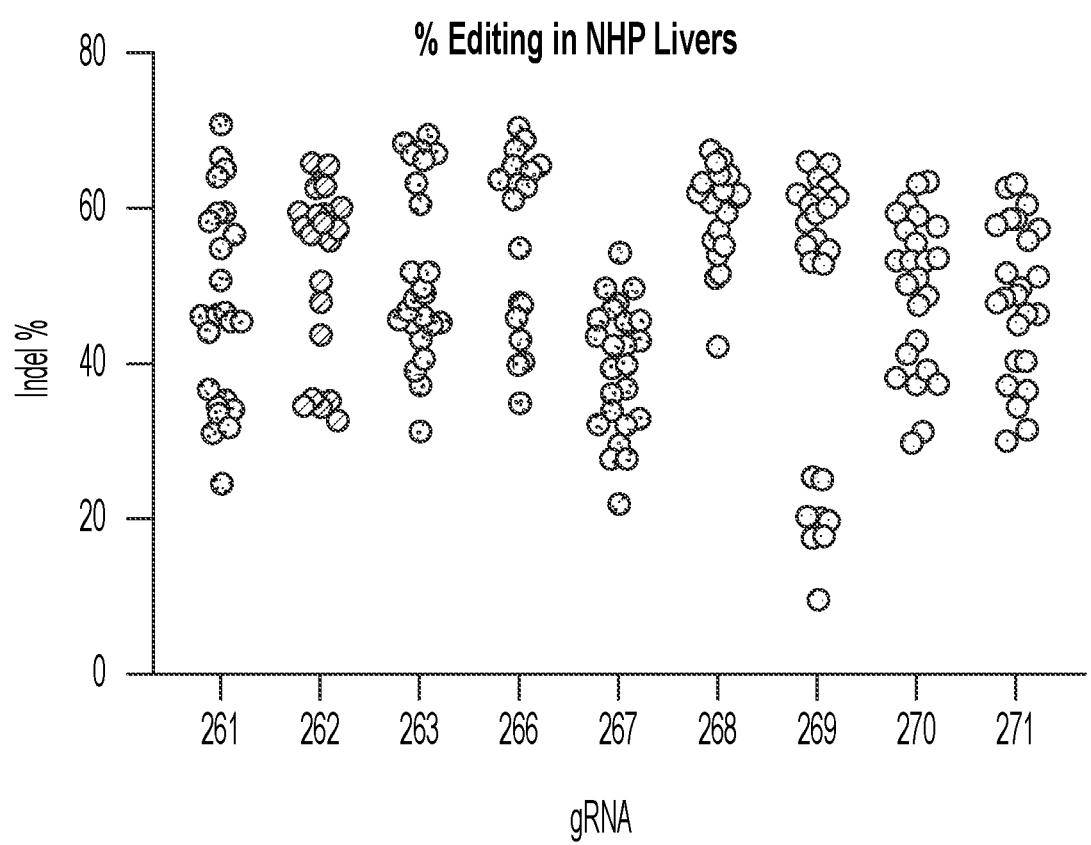
FIG. 51 illustrates liver editing in NHPs at 15 days after treatment with an LNP containing SpCas9 mRNA/gRNA.
Figure 52:
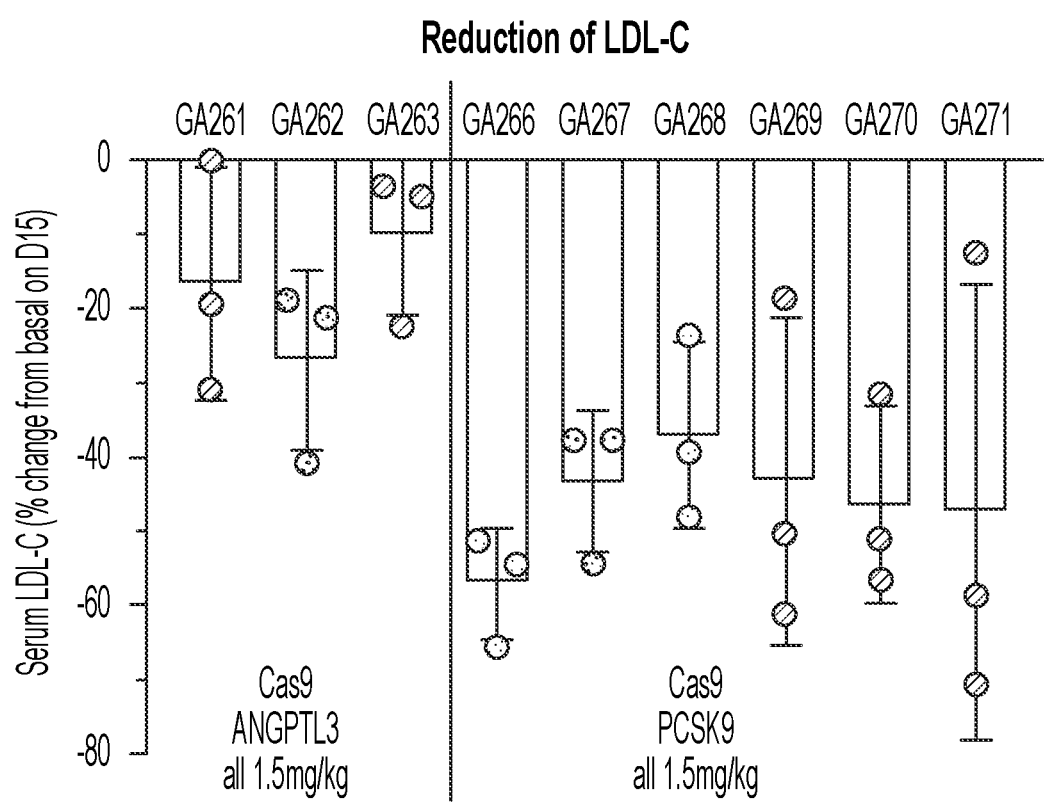
FIG. 52 illustrates LDL-C levels in NHPs at 15 days after treatment with SpCas9/gRNA.
Figure 53:
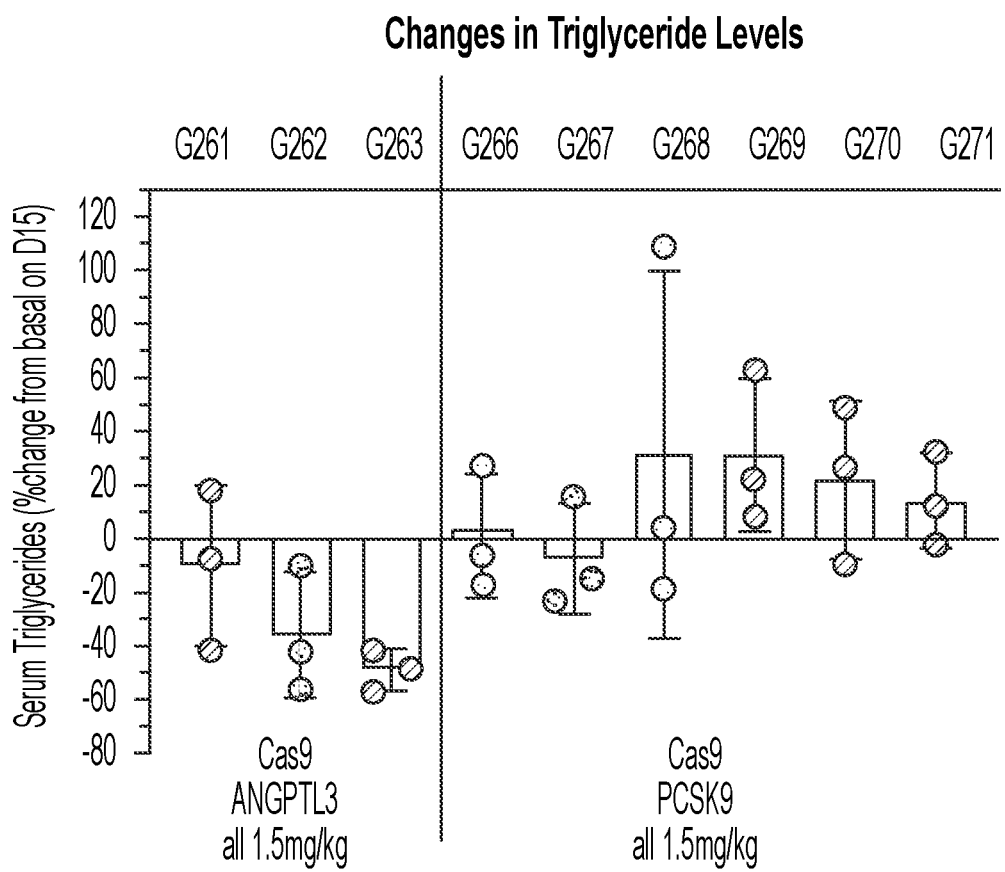
FIG. 53 illustrates triglyceride levels in NHPs at 15 days after treatment with SpCas9/gRNA.

Gene editing of ANGPTL3 or PCSK9 in non-human primates was assessed. Cynomolgus monkeys received an intravenous infusion of a 1.5 mg/kg dose of an LNP formulation with SpCas9 mRNA MS004 and one gRNA targeting either ANGPTL3 (GA261-GA263) or PCSK9 (GA266-GA271). Upon necropsy after 2 weeks, two pieces from each liver lobe (8 pieces total) were isolated and gDNA was extracted. Samples were processed as described in the detailed methods section. Indel % was analyzed for each separate piece and are graphed as individual points (FIG. 51). High editing efficiency was observed in most NHP livers. LDL-C levels were measured (FIG. 52). All NHPs that received LNPs with SpCas9 mRNA/PCSK9 gRNA had at least 35% reduction in circulating LDL-C levels. Although more modest, LNPs with SpCas9 mRNA/ANGPTL3 gRNA had 10-25% reduction in circulating LDL-C levels. Additionally, NHPs that received LNPs with SpCas9 mRNA/ANGPTL3 gRNA had around 10-50% reduction in triglyceride levels (FIG. 53). NHPs that received LNPs with SpCas9 mRNA/PCSK9 gRNA did not show a significant reduction in triglyceride levels.

Cynomolgus primary hepatocytes were transfected at 2500, 1250, and 625 ng/test article/mL with SpCas9 mRNA MS002 and a gRNA targeting PCSK9 with modifications to the tracr. Genomic DNA was processed, sequenced, and analyzed as described in the detailed methods section. GA266 was transfected independently twice to serve as two positive controls. Almost all transfections resulted in high editing efficiency compared to positive control, while GA405 had slightly lower editing efficiency.

TABLE 22

Modifications to guides retain on-target editing efficiency in cynomolgus primary hepatocytes.

| | Cynomolgus Primary Hepatocytes- % Editing (dose, replicate #) | | | | | |
|---|---|---|---|---|---|---|
| gRNA | 2500, rep1 | 2500, rep2 | 1250, rep1 | 1250, rep2 | 625, rep1 | 625, rep2 |
| GA266, #1 | 56.51 | 49.95 | 51.81 | 55.2 | 44.53 | 42.53 |
| GA266, #2 | 50.34 | 48.3 | 43.56 | 46.2 | 39.75 | 36.59 |
| GA395 | 43.91 | 49.53 | 41.48 | 44.35 | 33.87 | 34.57 |
| GA396 | 53.98 | 56.84 | 56.02 | 52.02 | 44.44 | 41.53 |
| GA397 | 56.65 | 58.59 | 56.47 | 58.68 | 40.72 | 46.28 |
| GA398 | 59.85 | 63.97 | 56.45 | 55.21 | 39.09 | 44 |
| GA399 | 58.97 | 62.75 | 55.55 | 53.02 | 37.75 | 41.8 |
| GA401 | 53.74 | 52.79 | 49.12 | 48.83 | 38.33 | 38.77 |
| GA402 | 45.58 | 55.34 | 44.46 | 47.93 | 35.05 | 40.31 |
| GA403 | 52.62 | 55.84 | 50.5 | 47.13 | 38.28 | 35.58 |
| GA404 | 48.3 | 50.59 | 41.68 | 35.04 | 31.63 | 30.16 |
| GA405 | 41.85 | 47.33 | 35.84 | 35.88 | 26.2 | 26.36 |
| GA406 | 57.17 | 51.45 | 45.11 | 43.68 | 37.58 | 40.31 |
| GA408 | 50.4 | 46.92 | 47.21 | 49.8 | 36.7 | 37.14 |

Figure 54A:
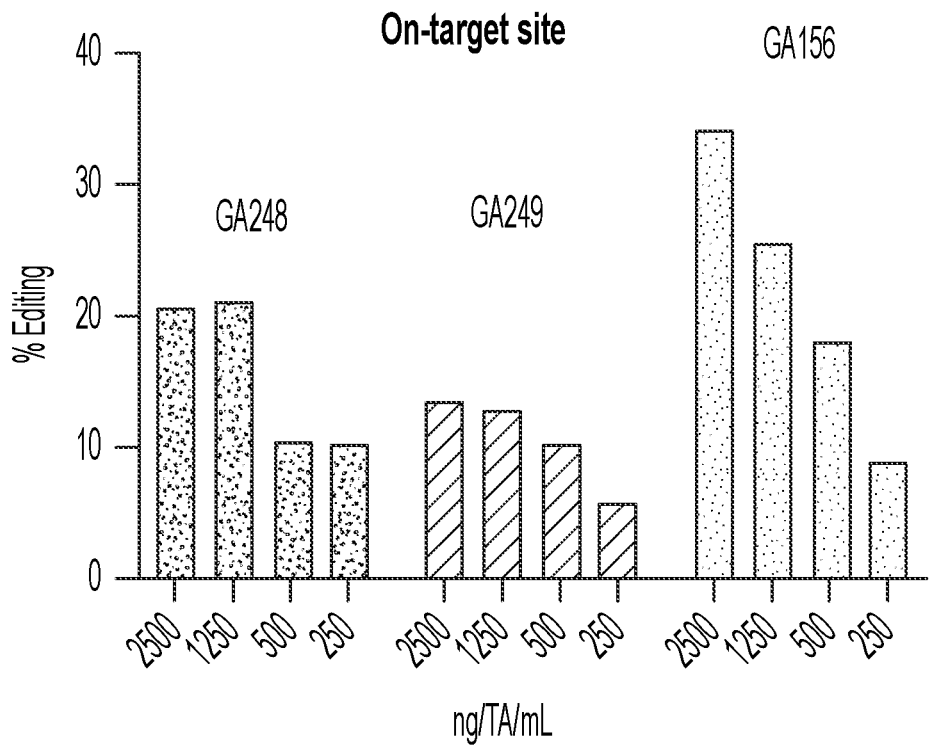
FIGS. 54A and 54B illustrate that PACE-modifications to the gRNA decrease off-target editing efficiency. Human primary hepatocytes were transfected at 2500, 1250, 500, and 250 ng/test article/mL with SpCas9 mRNA (commercially purchased from Trilink) and a gRNA targeting PCSK9 with modifications to the tracr. Genomic DNA was processed, sequenced, and analyzed as described in the detailed methods section. GA156 was transfected to serve as a positive control. GA248 and GA249 contain PACE-modifications to the gRNA that have previously been demonstrated to decrease off-target editing efficiency. Indeed, although GA248 and GA249 had lower on-target editing compared to the unmodified gRNA, GA156 (FIG. 54A), GA248 and GA249 showed decreased off-target editing at an identified off-target site (FIG. 54B).
Figure 54B:
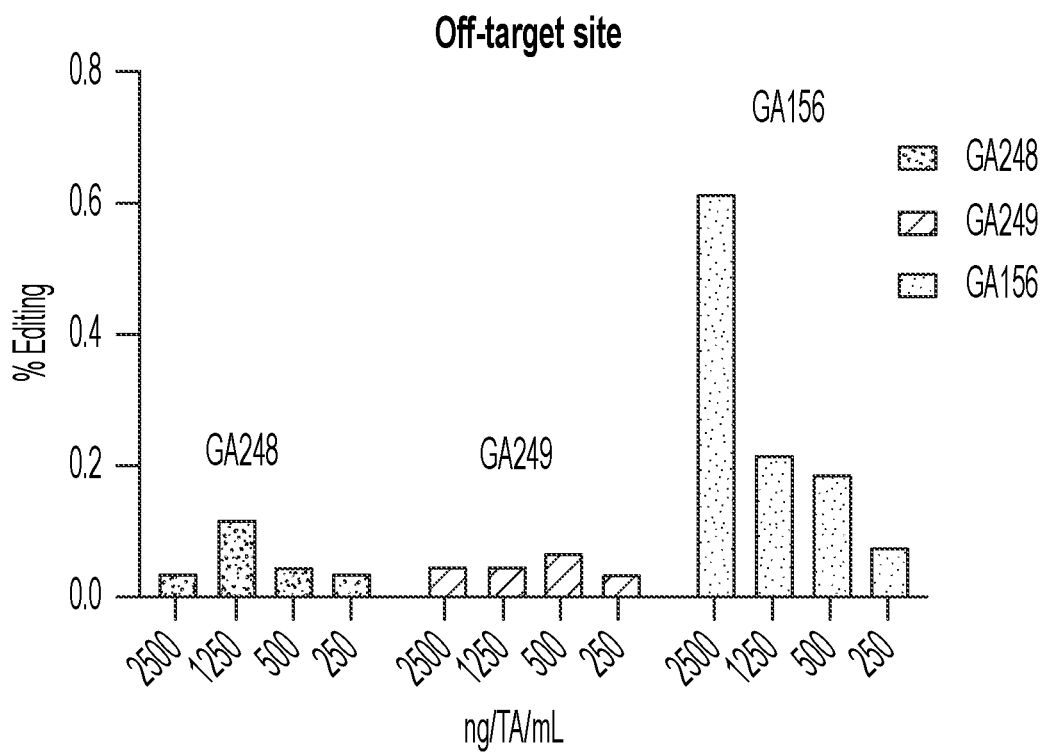

PACE-modifications to the gRNA have been previously demonstrated to reduce off-target editing efficiency. Human primary hepatocytes were transfected at 2500, 1250, 500, and 250 ng/test article/mL with SpCas9 mRNA MS002 and a gRNA targeting PCSK9 with modifications to the tracr. Genomic DNA was processed, sequenced, and analyzed as described in the detailed methods section. GA156 was transfected to serve as a positive control. GA248 and GA249 contain PACE-modifications to the gRNA that have previously been demonstrated to decrease off-target editing efficiency. Indeed, although GA248 and GA249 had lower on-target editing compared to the unmodified gRNA, GA156 (FIG. 54A), GA248 and GA249 showed decreased off-target editing at an identified off-target site (FIG. 54B).

Figure 55A:
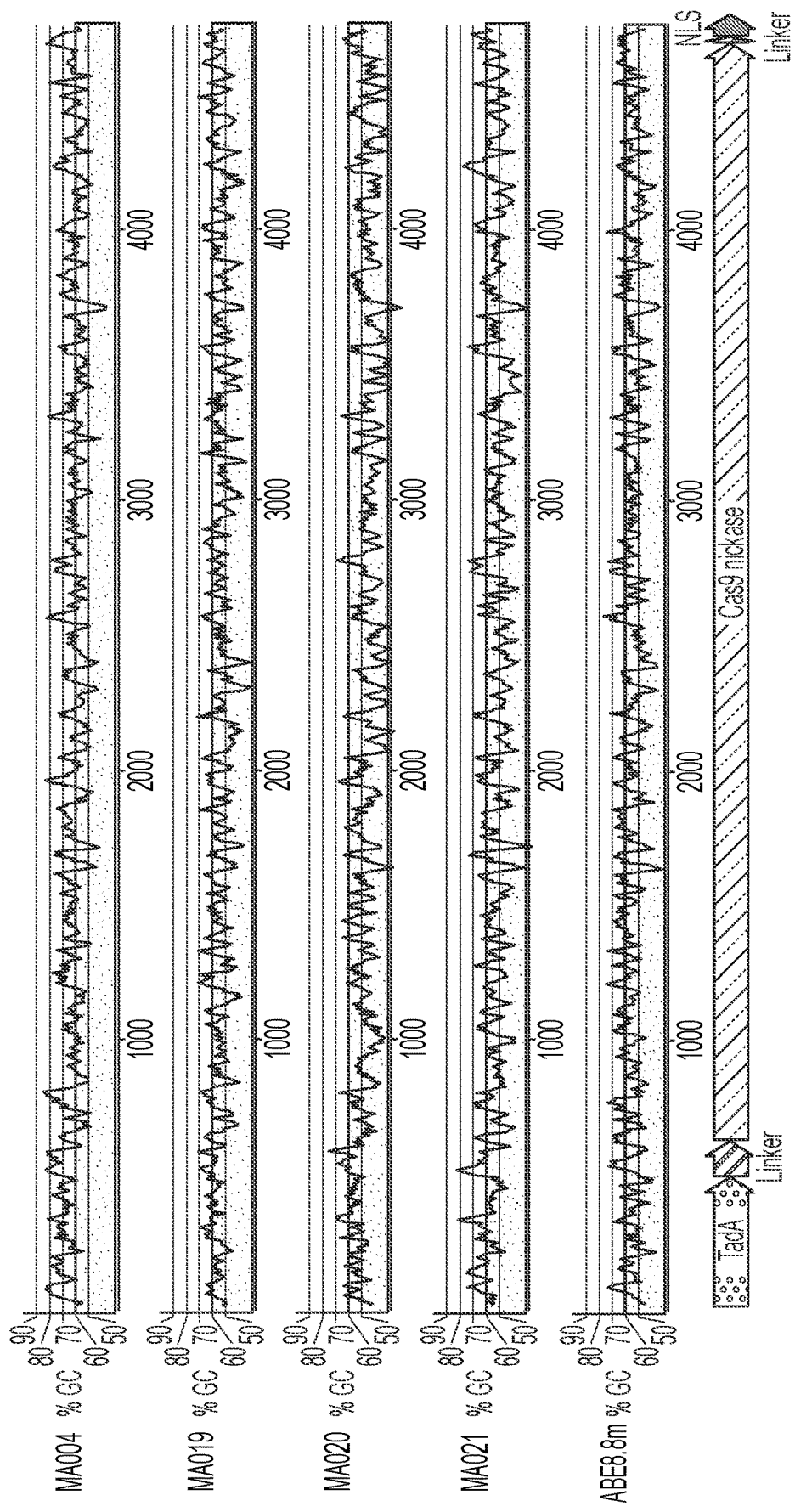
FIG. 55A illustrates the GC comparison of ABE-encoding nucleotides, MA004, MA019, MA020, MA021, and ABE8.8m (Table 23), as well as a more detailed look at MA004 (FIG. 55A, bottom panel).
Figure 55A:
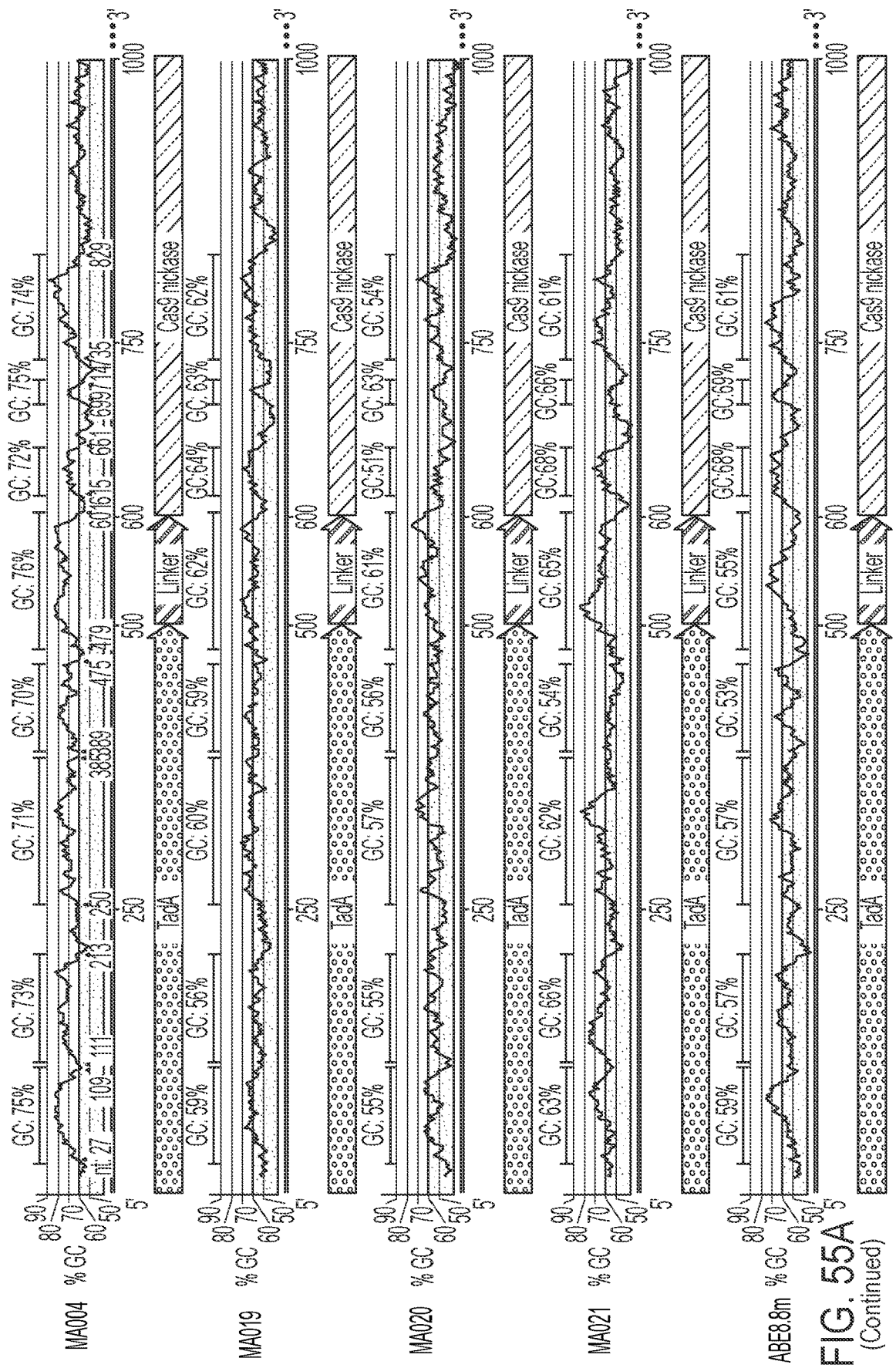
Figure 55A:
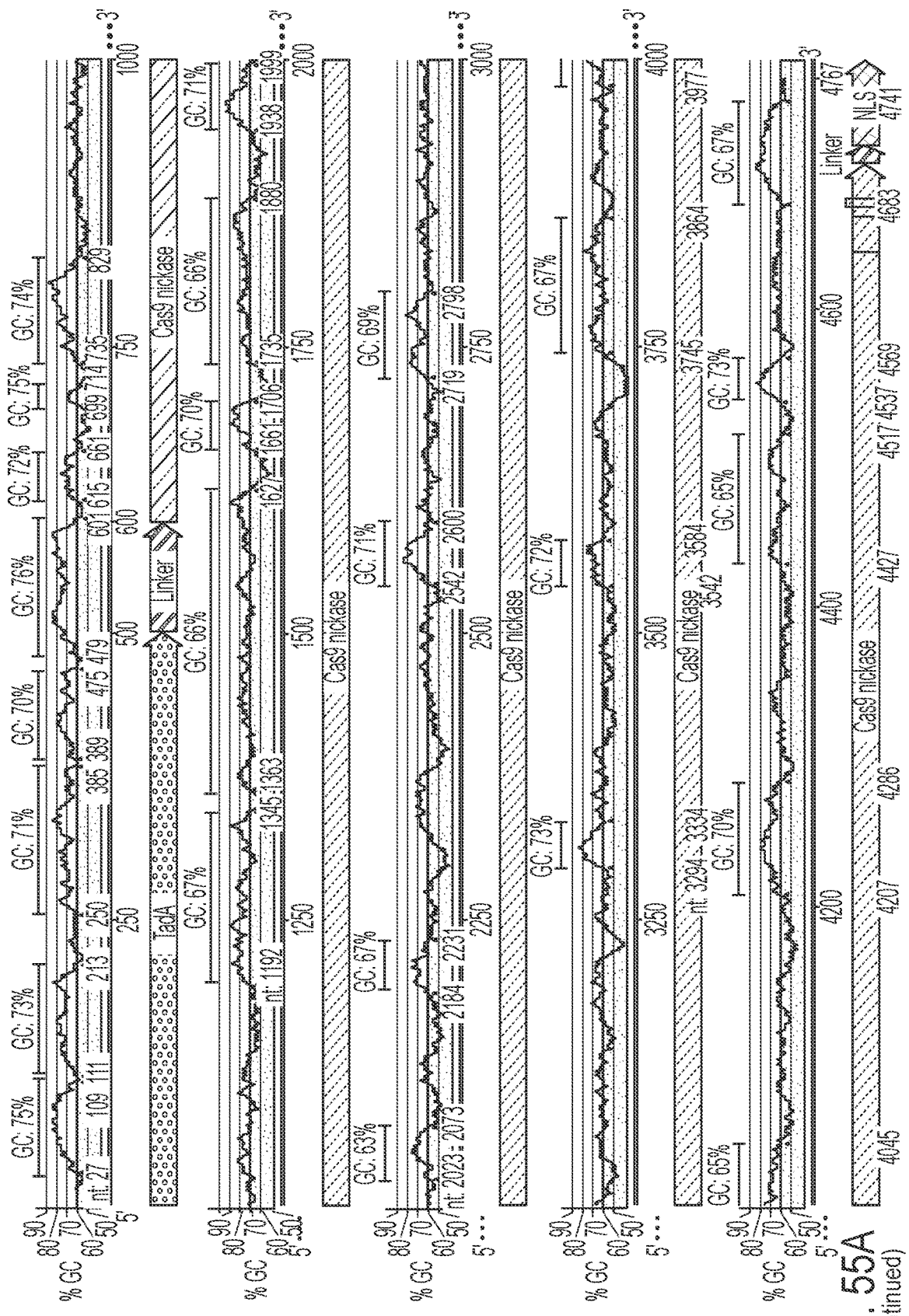

ABE mRNA sequences— MA004, MA019, MA020, and MA021— were evaluated for their GC content (FIG. 55A). In general, MA004 sequence has a higher GC content than MA019, MA020, MA021, and ABE8.8m sequences. GC levels in sequence MA004 are also elevated (above 60%) in certain regions throughout the ABE sequence such as the TadA domain, N-terminal linker, and C-terminal linker, as well as various sub-regions. For all sequences, GC levels below 60% are shaded in gray to provide contrast to the elevated GC regions. GC content is calculated by determining the relative amount of G and C within a given 25 nucleotide stretch across the entire mRNA sequence, i.e. for every 25 nucleotides, the sum of G's and C's is divided by the total number of nucleotides. This comparison shows that mRNA MA4 sequence has a distinct distribution and enrichment of G and C nucleotides relative to other mRNA sequences.

The region-specific GC characterization of sequence MA004 is further illustrated (FIG. 55). The graph in each row shows the GC content in every 1,000-nucleotide stretch comprising the full ABE coding sequence (4,767 nt). The GC content is particularly high in the 5' end of the sequence, which includes the TadA region and the N-terminal linker. The GC content is also high various parts of the Cas9 nickase and in the 3' end of the ABE sequence; there the high GC is centered around the linker region instead of the NLS. Sub-regions with high GC content are delineated by where GC reaches a threshold level of 60%. GC content in each sub-region is calculated by determining the number of G and C nucleotides divided by the total number of nucleotides for each sub-region.

TABLE 26

GC comparison of ABE-encoding nucleotides, MA004, MA019, MA020, MA021, and ABE8.8m

| ABE sequence | MA004 | MA019 | MA020 | MA021 | ABE8.8m | ΔGC* |
|---|---|---|---|---|---|---|
| Region-specific GC % | | | | | | |
| Total sequence | 63 | 54 | 47 | 54 | 55 | 11 |
| TadA (nt: 1-501) | 70 | 58 | 54 | 60 | 54 | 14 |
| N-terminal linker (nt: 502-597) | 79 | 64 | 65 | 54 | 59 | 19 |
| Cas9 nickase (nt: 598-4698) | 62 | 54 | 45 | 53 | 56 | 10 |
| C-terminal linker (nt: 4699-4710) | 83 | 58 | 67 | 58 | 60 | 22 |
| NLS (nt: 4711-4767) | 63 | 53 | 49 | 60 | 48 | 11 |
| Sub-region GC % | | | | | | |
| nt: 27-109 | 75 | 59 | 55 | 63 | 59 | 16 |
| nt: 111-213 | 73 | 56 | 55 | 66 | 57 | 15 |
| nt: 250-385 | 71 | 60 | 57 | 62 | 57 | 12 |
| nt: 389-475 | 70 | 59 | 56 | 54 | 53 | 15 |
| nt: 479-601 | 76 | 62 | 61 | 65 | 55 | 15 |
| nt: 615-661 | 72 | 64 | 51 | 66 | 68 | 10 |
| nt: 699-714 | 75 | 63 | 63 | 56 | 69 | 12 |
| nt: 735-829 | 74 | 62 | 54 | 61 | 61 | 15 |
| nt: 1192-1345 | 67 | 58 | 51 | 55 | 61 | 11 |
| nt: 1363-1627 | 66 | 58 | 52 | 55 | 61 | 10 |
| nt: 1661-1706 | 70 | 57 | 57 | 65 | 63 | 10 |
| nt: 1735-1880 | 66 | 54 | 52 | 57 | 60 | 10 |
| nt: 1938-1999 | 71 | 60 | 55 | 63 | 60 | 12 |
| nt: 2023-2073 | 63 | 55 | 45 | 53 | 63 | 9 |
| nt: 2184-2231 | 67 | 60 | 54 | 63 | 60 | 8 |
| nt: 2542-2600 | 71 | 63 | 51 | 53 | 64 | 13 |
| nt: 2719-2798 | 69 | 56 | 54 | 65 | 64 | 9 |
| nt: 3294-3334 | 73 | 61 | 54 | 61 | 66 | 13 |
| nt: 3542-3584 | 72 | 67 | 58 | 72 | 67 | 6 |
| nt: 3745-3864 | 67 | 54 | 53 | 57 | 62 | 11 |
| nt: 3977-4045 | 65 | 57 | 48 | 59 | 59 | 9 |
| nt: 4207-4286 | 70 | 56 | 54 | 66 | 59 | 11 |
| nt: 4427-4517 | 65 | 60 | 51 | 53 | 55 | 10 |
| nt: 4537-4569 | 73 | 58 | 48 | 64 | 61 | 15 |
| nt: 4583-4741 | 67 | 58 | 49 | 57 | 61 | 11 |

ΔGC is the difference between the GC content of sequence MA004 CDS (cDNA sequence) and the average of sequences MA019 CDS, MA020 CDS, MA021 CDS, and ABE8.8m.

Figure 55B:
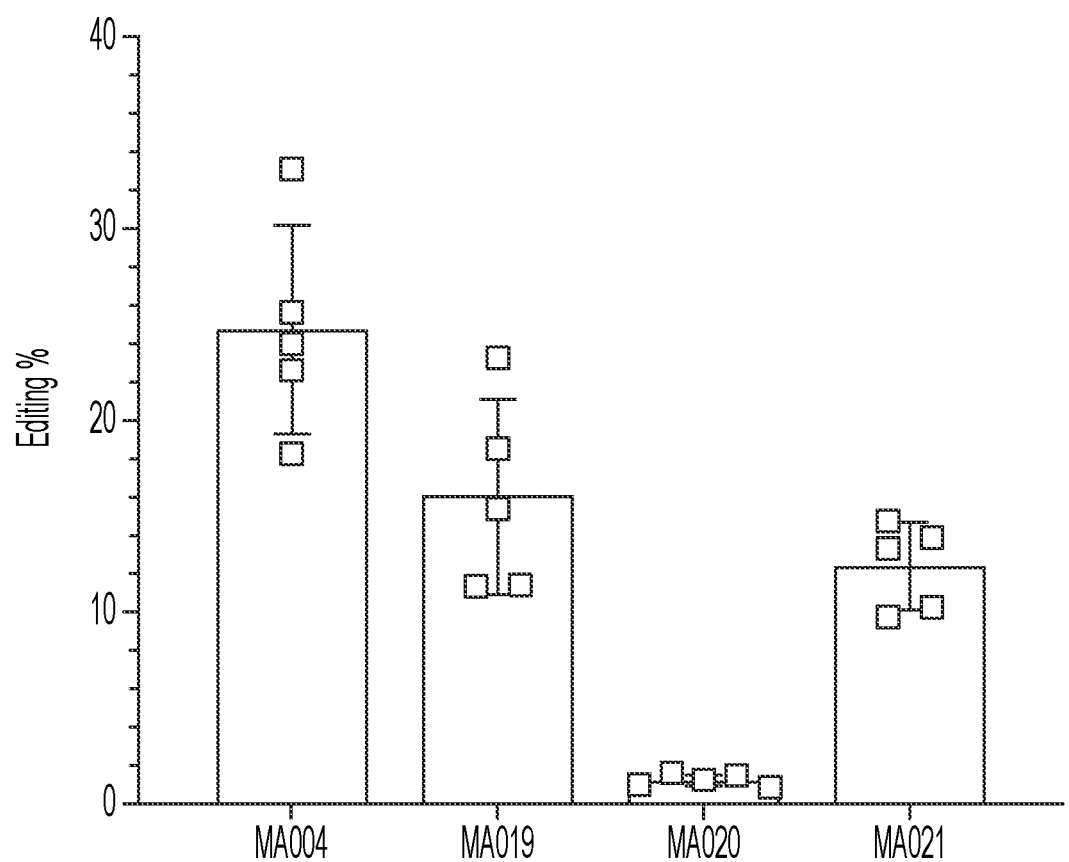
FIG. 55B illustrates the editing % obtained using ABE-encoding nucleotides, MA004, MA019, MA020, and MA021 (Table 23).

The editing efficiency of these mRNA constructs were assessed in mice (FIG. 55B). These mRNAs, MA004, MA019, MA020, and MA021 code for the same ABE protein sequence but have different nucleotide sequence optimizations. The only difference between these groups is the mRNA sequence; the mRNAs have the same base modifications, and each group used the same LNP formulation and gRNA. Each group was administered intravenously to mouse, and a low dose of 0.05 mg/kg was used in this study to achieve sub-saturating levels of liver editing to resolve efficacy differences. At day 5 post-dose, gDNA was isolated and base editing was assessed by next generation sequencing. These results demonstrate that mRNA sequence changes can affect adenosine base editing performance in vivo.

Additional Details of Methods Described

Plating, culturing, and transfection of primary hepatocytes. Primary human liver hepatocytes (PHH) and primary cynomolgus liver hepatocytes (PCH) from BioIVT were cultured per the manufacturer's protocol. Briefly, primary human hepatocytes and primary cyno hepatocytes were obtained as frozen aliquots from BioIVT. Four lots of primary human hepatocytes, each derived from a de-identified individual donor, were used for the experiments: STL (main donor) was used for all experiments, including screening experiments and off-target experiments; HLY, JLP, and TLY were used for off-target experiments. The HFG lot of primary cyno hepatocytes were used for experiments. Following the manufacturer's instructions, cells were thawed and rinsed prior to plating in 24-well plates that had been coated with bovine collagen overnight, with a density of approximate 350,000 cells/well in INVITROGRO hepatocyte medium supplemented with TORPEDO antibiotic mix (BioIVT). The cells were thawed and resuspended in hepatocyte thawing medium followed by centrifugation at 100 g for 10 min at 4° C. The supernatant was discarded, and the pelleted cells resuspended in hepatocyte plating medium. Each vial contains approximately 5 million cells that were used for plating one 24-well plate. Plated cells were allowed to settle and adhere for 4-6 h in a tissue culture incubator at 37° C. under 5% $CO_2$ atmosphere. After incubation, cells were checked for monolayer formation. The incubating media were then replaced with fresh hepatocyte maintenance media (complete INVITROGRO medium obtained from BioIVT, the cell line provider). The cells thus became ready for transfection. Each of the gRNAs were co-transfected with an equivalent amount of in vitro transcribed ABE8.8 mRNA (1:1 ratio by molecular weight) into primary human hepatocytes via MessengerMax reagent (Lipofectamine), using various dilutions to assess for editing activity at different concentrations of test article. MessengerMAX from Thermo Fisher is used for transfection. Solution A: desired amount of guide RNA is mixed with 1:1 wt ratio of mRNA in OptiMEM. Solution B: MessengerMAX in OptiMEM. After mixing solutions A and B, the mixture was incubated at room temperature for 20 min. 60 µL of the incubated solution was added dropwise to each cell wells. For protospacer sequences that were a perfect match to the corresponding cynomolgous monkey PCSK9 or ANGPTL3 gene sequence, each gRNA was also co-transfected with an equivalent amount of ABE8.8 mRNA (1:1 ratio by molecular weight) into primary cynomolgous hepatocytes, and followed the same transfection protocol. The cells were then allowed to remain at 37° C. for 3 days. Cells were harvested and prepared for genomic DNA extraction using either a Thermo Kingfisher, or Qiagen DNEasy blood and Tissue Kit, per manufacturer's instructions.

Bioinformatic analysis. Targeted amplicon sequencing data were analyzed with CRISPResso2 v2.0.31 in batch mode (CRISPRessoBatch). For Cas9 experiments, the following parameters were set: "--quantification_window_center-3-quantification_window_size 5--min_frequency_alleles_around_cut_to_plot 0.1-max rows alleles_around_cut_to_plot 100". For ABE experiments, the following parameters were set: "-default_min_aln_score 95--quantification_window_center-10--quantification_window_size 10-base editor_output--conversion_nuc from A-conversion_nuc_to G--min_frequency_alleles_around_cut_to_plot 0.1--max rows alleles_around_cut_to_plot 100". For NHP experiments, an additional parameter was set to exclude low quality reads: "--min_single_bp_quality 30". Moreover, in all cases, the parameter "--max_paired_end_reads_overlap" was set to 2R-F+0.25*F, following FLASH recommendations (http://ccb.jhu.edu/software/FLASH/), where R was the read length and F was the amplicon length.

Editing was quantified from the "Quantification_window nucleotide percentage_table.txt" output table as the percentage of reads that supported any A-to-G/C/T substitution in the main edited position (position 6 of the protospacer DNA sequence). Indels were quantified from the "Alleles frequency_table_around_sgRNA *.txt" output table as the percentage of reads that supported insertions or deletions over a 5-bp window on either side of the nick site (at position-3 upstream of the PAM sequence), having excluded reads that supported deletions larger than 30 bp. For candidate off-target sites, editing was quantified from the "Alleles frequency_table_around_sgRNA-*.txt" output table as the percentage of reads from alleles with an A→G substitution in the editing window (positions 1-10 in the PAM distal side of the protospacer), having excluded reads from alleles with deletions larger than 30 bp.

Reverse transcription. The collected cells were processed with the miRNeasy Mini Kit (QIAGEN) according to the manufacturer's instructions to isolate both large and small RNA species, with the other part harvested for genomic DNA to establish PCSK9 editing and thereby confirm base editor activity in the cells._Reverse transcription was performed using the iScript Reverse Transcription Supermix reagent according to the manufacturer's instructions, with four different primer pairs used for PCR amplification of transcripts spanning exon 1 and exon 2, with or without any portions of intron 1. Paired-end reads of 250-bp length generated using an Illumina MiSeq System, as described above, were trimmed for adapters using trimmomatic v0.39 with parameters "ILLUMINACLIP:NexteraPE-PE.fa:2:30:10:1:true LEADING:3 TRAILING:3 SLIDINGWINDOW:4:15 MINLEN:36". Reads were then merged with FLASH v1.2.1134 and aligned to the PCSK9 gene body with Bowtie2 v2.4.1 with parameters "--local--very-sensitive-local-k 1--np 0". Gene annotations were obtained from Ensembl v98 (ftp://ftp.ensembl. org/pub/release-98/gtf/homo_sapiens/Homo_sapiens.GRCh38.98.gtf.gz). Alignments were filtered with samtools v1.10 and converted to BED format with the bedtools v2.25.0 bamtobed function. A minimum of 1000 mapped reads per sample were required and the end positions of mapped reads were tallied. Positions throughout PCSK9 intron 1 supported by a minimum of 10 reads in at least one treated sample are report.

ONE-seq analysis to predict candidate off-target sites. The design of a ONE-seq library starts with the computational identification of sites in a reference genome that have sequence homology to the on-target. For human ONE-seq libraries, the reference human genome (GRCh38, Ensembl v98, chromosomes ftp://ftp.ensembl.org/pub/release-98/fasta/homo_sapiens/dna/
Homo_sapiens.GRCh38.dna.chromosome.{1-22,X,Y, MT}.fa and ftp://ftp.ensembl.org/pub/release-98/fasta/homo_sapiens/dna/
Homo_sapiens.GRCh38.dna.nonchromosomal.fa), was searched for potential off-target sites with up to 6 mismatches to the protospacer sequence above, and sites with up to 4 mismatches plus up to 2 DNA or RNA bulges, using Cas-Designer vi.2 (http://www.rgenome.net/cas-designer/).

For the ONE-seq library pertaining to the cynomolgus monkey, the reference cynomolgus monkey genome (macFas5, Ensembl 98, chromosomes ftp://ftp.ensembl.org/pub/release-98/fasta/macaca_fascicularis/dna/Macaca_fascicularis.Macaca_fascicularis 5.0.dna.chromos ome.{1-20, X,MT}.fa.gz and ftp://ftp.ensembl.org/pub/release-98/fasta/macaca_fascicularis/dna/
Macaca_fascicularis.Macaca_fascicularis 5.0.dna.nonchromosal.fa.gz) was searched using similar parameters.

Sites with up to 6 mismatches and no bulges are referred to using a X<number of mismatches><number of bulges>code. As such, the on-target site is labelled as X00; a site with 1 mismatch to the on-target and no bulges is labelled as X10, and so on. Sites with DNA bulges are referred to with a similar nomenclature, DNA<number of mismatches><number of bulges>. As such, a site with 4 mismatches to the on-target and 2 DNA bulges is labelled as DNA42. The same nomenclature is used for RNA bulges, but these are coded as RNA<number of mismatches>number of bulges>.

The protospacer sequences identified were extended by 10 nucleotides (nt) on both sides with adjacent sequence from the respective reference genome (these regions are herein referred to as the genomic context). These extended sequences were then padded by additional sequences up to a final length of approximately 200 nt, including 6 pre-defined constant regions of different nucleotide composition and sequence length; 2 copies of a 14-nt site-specific barcode, one on each side of the central protospacer sequence; and 2 distinct 11-nt unique molecular identifiers (UMIs), one on each side of the central protospacer sequence. The UMIs are used to correct for bias from PCR amplification, and the barcodes allow for the unambiguous identification of each site during analysis. The barcodes are selected from an initial list of 668,420 barcodes, which contain neither a CC nor a GG in their sequences, and each barcode has a Hamming distance of 2 from any other barcode. A custom Python script was used for designing the final library.

The final oligonucleotide libraries are synthesized by a commercial vendor (Agilent Technologies). Each library is PCR-amplified and subjected to 1.25× AMPure XP bead purification (Beckman Coulter). After incubation at 25° C. for 10 minutes in CutSmart buffer (New England Biolabs), RNP comprising 769 nM recombinant ABE8.8-m protein and 1.54 µM gRNA is mixed with 100 ng of the purified library and incubated at 37° C. for 8 hours. The RNP dose is derived from an analysis documenting that it is a super-saturating dose, ie, above the dose that achieves the maximum amount of on-target editing in the biochemical assay.

Proteinase K (New England Biolabs) is added to quench the reaction at 37° C. for 45 minutes, followed by 2× AMPure XP bead purification. The reaction is then serially incubated with EndoV (New England Biolabs) at 37° C. for 30 minutes, Klenow Fragment (New England Biolabs) at 37° C. for 30 minutes, and NEBNext Ultra II End Prep Enzyme Mix (New England Biolabs) at 20° C. for 30 minutes followed by 65° C. for 30 minutes, with 2×AMPure XP bead purification after each incubation. The reaction is ligated with an annealed adaptor oligonucleotide duplex at 20° C. for 1 hour to facilitate PCR amplification of the cleaved library products, followed by 2× AMPure XP bead purification. Size selection of the ligated reaction is performed on a PippinHT system (Sage Sciences) to isolate DNA of 150 to 200 bp on a 3% agarose gel cassette, followed by 2 rounds of PCR amplification to generate a barcoded library, which undergoes paired-end sequencing on an Illumina MiSeq System as described above.

Two cleavage products are obtained in a ONE-seq experiment. The PROTO side includes the part of the oligonucleotide upstream of the cleavage position, whereas the PAM side includes part of the oligonucleotide downstream of the cleavage position. In an ABE experiment, only the PROTO side is informative of editing activity (an A-G substitution); therefore, only this side is sequenced.

Paired-end reads were trimmed for sequencing adapters using trimmomatic v0.39 (Bolger et al., 2014) with custom Nextera adapters (PrefixPE/1: ACACTCTTTCCCTA-CACGACGCTCTTCCGATCT; PrefixPE/2: GTGACTG-GAGTTCAGACGTGTGCTCTTCCGATCT; as specified in file) and parameters "ILLUMINACLIP:NEB_custom.fa:2:

30:10:1:true LEADING:0 TRAIL,ING:0 SLIDINGWINDOW:4:30 MINLEN:36". For experiments with lower sequencing quality (VOL014), these parameters were set to "ILLUMINACLIP NEB_custom.fa:2:30:10:1:true LEADING:2 TRAILING:0 SLIDINGWINDOW:30:30 MINLEN: 36". Reads were then merged using FLASH v1.2.11 (Magoc and Salzberg, 2011) with parameters "--max-mismatch-density=0.25--max-overlap=160". Merged reads were scanned for the constant sequences, barcodes and protospacer sequences unique to each site, and filtered to those with evidence of an A-G substitution in the editing window (defined as the 1-10 most PAM-distal positions of the protospacer). Duplicated reads were discarded.

For each site, the total number of edited reads was normalized to the total number of edited reads assigned to the on-target site, and this ratio defines the ONE-seq score for the site. Sites were ranked by ONE-seq score, and those with a score equal to or larger than 0.001, were selected for validation. This implies the sponsor follows up on sites that have down to 1000-fold less editing activity in the biochemical assay compared to editing of the on-target site. This threshold is based on the premise that in cells, if there is 100% on-target editing, 1/1000-fold less editing activity would translate to <0.1% off-target editing, which falls below the lower limit of detection of editing by NGS.

SureSelect. SureSelect panels were designed and purchased from Agilent Technologies. Bases in raw FASTQ files with quality lower than 30 were masked to Ns using seqtk v1.3-r106 (https://github.com/lh3/seqtk). Adapters were trimmed using the "Trimmer" script in Agilent's AGeNT v2.0.5 tool. Reads were aligned to the GRCh38 reference human genome (ftp://ftp.ncbi.nlm.nih.gov/genomes/all/GCA/000/001/405/
GCA_000001405.15_GRCh38/seq s_for_alignment_pipelines.ucsc_ids/
GCA_000001405.15_GRCh38_no_alt_analysis_set.fna) using BWA MEM v 0.7.17-ri 188 with parameter "—C". Aligned reads were processed and duplicates were removed using the "LocatIt" script in Agilent's AGeNT v2.0.5 tool, with parameters "-1-R-IB-OB-U-1<Covered.bed >". Nucleotide distributions at each position in the editing window (positions 1-10 in the PAM distal side of the protospacer) were determined using perbase v0.6.3 (https://github.com/sstadick/perbase), with parameters "base-depth-F 3848". Editing was quantified by summing the percentage of reads supporting an A-G substitution in the editing window.

RNA-seq for guide-independent off-target analysis. The RNA samples were processed and sequenced by GENEWIZ; following rRNA depletion, libraries were prepared and underwent 2x150-bp paired-end sequencing on an Illumina HiSeq System, with approximate 50 million reads per sample. RNA-seq variant calling for all samples was executed using GATK Best Practices. In short, reads were aligned using STAR to the GRCh38 reference genome (ftp.ncbi.nlm.nih.gov/genomes/all/GCA/000/001/405/
GCA_000001405.15_GRCh38/seqs_fo r_alignment_pipelines.ucsc_ids/
GCA_000001405.15_GRCh38_no_alt_analysis_set.fna.gz) with gencode v34 (ftp://ftp.ebi. ac.uk/pub/databases/gencode/Gencode_human/release_34/gencode.v34.primary
assembly.annotation.gtf.gz). PCR duplicates were removed using GATK MarkDuplicates, followed by variant identification using GATK HaplotypeCaller. Variants were then filtered by excluding those with QD (Quality of Depth)<2.0 and FS (Fisher strand—evidence of strand bias)>30. All GATK analyses were performed with gatk4 v4.1.8.1.

Variants obtained as above were further filtered by comparison with untreated control samples as follows. (1) Nucleotide distributions at each identified variant in treated cells each untreated control sample and each treated sample using perbase v0.5.1 (https://github.com/sstadick/perbase). (2) For all variants covered by at least 20 reads in both treated and untreated conditions, RNA edits were identified as those that had the reference allele (A or T) in at least 95% of reads in all untreated control samples and the alternate allele (G or C) in at least one read in the treated sample. The above steps were executed with each of the ABE8.8-treated and SpCas9-treated samples.

Guide RNA synthesis. The guide RNAs shown in Table 1 were/are synthesized under solid phase oligonucleotide synthesis and deprotection conditions using controlled pore glass support and commercially available phosphoramidite monomers and oligonucleotide synthesis reagents (Methods in Molecular Biology, 1993, 20, 81-114; ACS Chem. Biol. 2015, 10, 1181-1187, incorporated herein by reference in its entirety). The spacer section of the guide RNAs were converted to the corresponding ribonucleotides except the first 1-3 nucleotides from the 5'-end. The first 1-3 nucleotides from the 5'-end was/were converted to the corresponding 2'-O-methylribonucleotide as outlined in Table 1. The deprotected guide RNAs were purified by HPLC and the integrity of each guide RNA was confirmed by mass spectrometric analysis. The observed mass of each guide RNA was conformed to calculated mass. [748] mRNA production by in vitro transcription (IVT) The mRNA described herein are produced by different methods well known in the art. One of such methods is in vitro transcription (IVT) using T7 polymerase or additional RNA polymerase variants. Typically, IVT of mRNA uses a linearized DNA template that comprises a T7 polymerase promoter and associated regulatory sequences, mRNA coding sequence (CDS), 3' and 5' untranslated regions (UTRs), poly A tail, and additional sequence elements to enhance mRNA stability and in vivo performance. Prior to IVT, the DNA template is in the form of a plasmid, PCR product, synthetic DNA product, or any other double-stranded DNA construct; linearization of the DNA template, typically with a restriction digestion enzyme, is performed to promote run-off transcription. A typical IVT reaction includes T7 polymerase, DNA template, RNase inhibitor, cap analog, inorganic pyrophosphatase, and naturally occurring ribonucleotide triphosphates (NTPs) such as GTP, ATP, CTP, UTP, or substitutions of natural NTPs with modified NTPs such as pseudouridine, N1-methylpseudouridine, 5'methylcytidine, 5-methoxyuridine, N6-methyladenosine, and N4-acetylcytidine. The cap analog can be added during transcription or supplemented after the IVT reaction using a capping enzyme; in both instances a 2'-O-methyl group, or additional 2' chemical modification, is added to first initiating nucleotide to produce a cap-1 form of mRNA. In some instances, poly A tail is added to the mRNA after the IVT reaction using an RNA ligase enzyme. After IVT, in some cases DNase is added to the transcription mixture to remove DNA template; alternatively, residual DNA is removed with chromatography, precipitation, or tangential flow filtration. Purification and concentration of mRNA is performed with methods such as ion exchange chromatography, affinity chromatography, precipitation, ion-pairing reversed-phase chromatography, hydrogen bond chromatography, cellulose chromatography, reversed-phase chromatography, enzymatic reactions, size exclusion chromatography, and tangential flow filtration. Similar IVT and purification process are used to produce mRNA encoding luciferase, eGFP, SpCas9, Cas12b, CBE, and ABE; in all cases the DNA template, reaction conditions, and purification parameters are optimized for the specific gene of interest.

Figure 30:
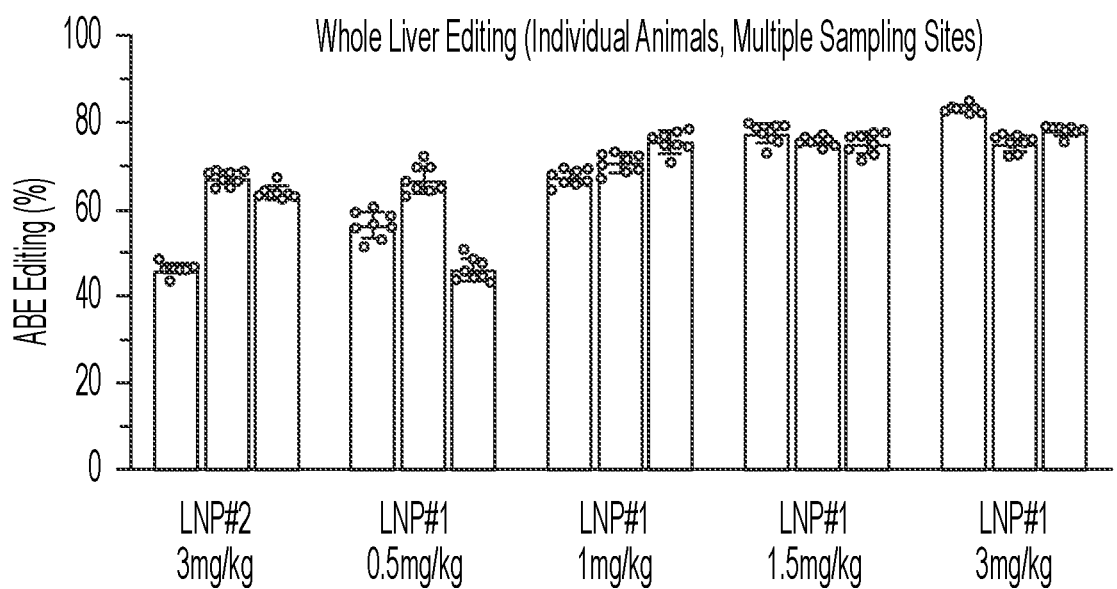
FIG. 30 shows adenine base editing of PCSK9 in non-human primates. This graph depicts editing of the PCSK9 exon 1 splice-donor adenine base in the livers of cynomolgus monkeys (each bar is an individual animal, with editing recorded for multiple sampling areas) receiving an intravenous infusion of 0.5, 1.0, 1.5, or 3 mg/kg total RNA dose of LNP #1. LNP #2 at 3 mg/kg total RNA was dosed as a benchmark from a previous study. Both LNP formulations contain ABE8.8 mRNA MA004 and PCSK9 gRNA GA346.

Lipid nanoparticle formulation and analysis. LNPs used were formulated as previously described (Conway, A. et al. 2019 Mol. Ther. 27, 866-877; Villiger, L. et al 2021 Nat. Biomed Eng. 5, 179-189) and generated either by (1) microfluidic mixing using the Precision Nanosystems NanoAssemblr system according to the manufacturer's protocol, with some optimization for individual payloads or by (2) rapid inline mixing of a solution of lipid excipients in an organic solvent and an aqueous solution of gRNA and mRNA. The lipid solution generally comprises of a mixture of four formulation excipients namely: an amino lipid, a monomethoxypolyethylene glycol (or methoxypoluyethyle glycol) of average molecular weight 2000 Da conjugated to a lipid called PEG-Lipid, cholesterol and 1,2-distearoyl-sn-glycero-3-phosphocholine (DSPC), mixed in a predetermined molar ratio in ethanol. LNP composition comprised 40-65% of amino lipid, 2-20% DSPC, 1-5% PEG-Lipid, with the balance being cholesterol (all in mol %). The RNA aqueous solution contains a 1:1 by weight mixture of desired mRNA and guide RNA (gRNA) unless otherwise specified. For evaluating impact of mRNA to gRNA ratio, aqueous solution containing desired weight ratio of mRNA and gRNA were prepared prior to the preparation of corresponding LNPs, for evaluation; for example, the preparation of LNP test article to evaluate 6:1, 3:1, 2:1, 1:1, 1:2, 1:3 and 1:6 mRNA to gRNA ratio in mice (Example 6, FIG. 19). In some other instances, the mRNA and two gRNAs were mixed in 1:0.5:0.5 (mRNA:gRNA1:gRNA2) weight ratio to prepare LNPs containing desired mRNA and two gRNAs in a single test article (Example 10, FIG. 43). The aqueous solution of desired mRNA to gRNA was then mixed with the lipid excipients in ethanol by microfluidic or by rapid inline mixing. All LNPs for reported NHP studies were prepared by following the inline mixing protocols as described WO 2019/036028 A1, WO 2015/199952 A1, WO 2017/004143, WO 2020/081938 A1 and WO 2020/061426 A2. The PEG-Lipid used for the preparation of the NHP LNP test articles was selected from WO 2019/036028 A1, WO 2015/199952 A1. The LNP compositions and ionizable amino lipids were selected from the from Patent Publications WO/2017/004143A1, WO/2017/075531A1 and WO/2018/191719 A1. The ionizable amino lipids used for the preparation of LNP #1 and LNP #2 (Example 8, FIG. 30 & FIG. 45) were selected from the publication WO 2018/191719 A1. The resulting LNP formulations were subsequently dialyzed against test article buffer and filtered using a 0.2 μm sterile filter.

As an example, the LNPs used for cellular and NHP studies had an average hydrodynamic diameter range of 55 to 65 nm, with a polydispersity index of <0.2 as determined by dynamic light scattering and 85-98% total RNA encapsulation as measured by the Quant-iT Ribogreen Assay. The LNP particle size (Z-Ave, hydrodynamic diameter), polydispersity index and total RNA encapsulation were measured as described in the literature prior to administration.

As an example, the LNPs used for cellular and mouse studies had a particle size of 55-120 nm (Z-Ave, hydrodynamic diameter), with a polydispersity index of <0.2 as determined by dynamic light scattering (Malvern NanoZS Zetasizer) and 85-100% total RNA encapsulation as measured by the Quant-iT Ribogreen Assay (Thermo Fisher).

Genomic DNA extraction. The whole mouse liver or 100-200 mg of monkey liver was loaded into 2 mL lysing matrix tubes (MP Bio). Livers were lysed with 0.5 ml PBS for the mouse liver or 0.25 mL PBS for the monkey liver, using the FastPrep-24 system (MP Bio) according to the manufacturer's protocol. Genomic DNA was isolated from approximately 20 L of mouse or monkey liver lysate using a bead-based extraction kit, MagMAX-96 DNA Multi-Sample Kit (Thermo-Fisher Scientific) on the KingFisher Flex automated extraction instrument (Thermo-Fisher Scientific) according to the manufacturer's protocols. For monkey liver biopsy samples, Qiagen DNEasy Blood & Tissue kit extraction was used to extract genomic DNA according to the manufacturer's instructions. Extracted genomic DNA was stored at 4° C. until further use or at −80° C. for long term storage.

PCSK9 protein levels quantified by ELISA. Blood samples were collected and processed to plasma following blood draw. The plasma cynomolgus PCSK9 levels were determined by ELISA using the described ELISA; briefly, test samples or standards of purified cynomolgus monkey PCSK9 diluted in assay diluent D (Biolegend, part #76384) were incubated with assay buffer A (Biolegend, part #78232) in a 96-well microplate coated with a monoclonal antibody specific for human PCSK9 (Biolegend, part #76157). After four washes with wash buffer (Biolegend, part #78233), a polyclonal antibody specific for human PCSK9 (Biolegend, part #76158) was incubated in individual wells. After four washes, avidin-HRP (Biolegend, part #77897) were next incubated in individual wells. After six washes, substrate solution F (Biolegend, part #79132), which contains TMB, was used to develop the plate. Optical density was determined using on a microplate reader set to 450 nm. Readings at 570 nm were subtracted from the readings at 450 nm to correct for optical imperfections in the plate. Blood samples were collected and processed to plasma following blood draw and stored at −86 to −60° C. until analysis.

ANGPTL3 protein levels quantified by ELISA. The plasma cynomolgus ANGPTL3 levels were determined by ELISA; briefly, test samples or standards of purified cynomolgus monkey ANGPTL3 diluted in calibrator diluent RD6Q (R&D, part #895128) were incubated with assay diluent RD1-76 (R&D, part #895812) in a 96-well microplate coated with a monoclonal antibody specific for human ANGPTL3 (R&D, part #893734). After four washes with wash buffer (R&D, part #895003), human ANGPTL3 conjugate (R&D, part #893735) which contains a polyclonal antibody specific for human ANGPTL3 conjugated to horseradish peroxidase (HRP) were next incubated in individual wells. After four washes, TMB substrate solution (R&D, part #895000 and 895001) was used to develop the plate. Optical density was determined using on a microplate reader set to 450 nm. Readings at 540 nm were subtracted from the readings at 450 nm to correct for optical imperfections in the plate.

Quantifying lipid levels. Reagent kits each analyte contain reagent, cholesterol, triglycerides and HDL-C are quantified using absorbance measurements of specific enzymatic reaction products. LDL-C is determined indirectly. Most of the circulating cholesterol is found in three major lipoprotein fractions: very low-density lipoproteins (VLDL), LDL and HDL. [Total C]=[VLDL-C]+[LDL-C]+[HDL-C]. Thus the LDL-C can be calculated from measured values of total cholesterol, triglycerides and HDL-C according to the relationship: [LDL-C]=[total C]− [HDL-C]− [TG]/5, where [TG]/5 is an estimate of VLDL-cholesterol expressed. These results provide a preclinical proof of concept of a base-editing therapy knocking down PCSK9 in the human liver in vivo and effecting reductions in blood PCSK9 protein and LDL-C levels.

Direct measurement of triglyceride levels. A clinical analyzer instrument is used to measure a 'lipid panel' in serum samples. This entails the direct measurement of cholesterol (total C), triglycerides (TG) and high-density lipoprotein cholesterol (HDL-C). A reagent kit specific for triglycerides contains buffers, calibrators, blanks and controls. Using the provided reagents, serum samples from the study are analyzed. Triglycerides are measured using a series of coupled enzymatic reactions. $H_2O_2$ is the end product of the last one and its absorbance at 500 nm is used to quantify the analyte. The color intensity is proportional to triglyceride concentrations. All values are reported in mg/dL.

LNP treatment of mice. The mouse studies were approved by the Institutional Animal Care and Use Committee of the Charles River Accelerator and Development Lab (CRADL), where the studies were performed. Female C57BL/6J mice were obtained from The Jackson Laboratory and used for experiments at 8-10 weeks of age, with random assignment of animals to various experimental groups. LNP were administered to the mice via injection into the lateral tail vein and/or retro-orbital injection of the of the venous sinus (Lab Anim 2011; 40(5): 155-160) at mg/kg doses that correspond to mg of total RNA per animal weight (kilogram). The dose is calculated based on total RNA that constitute the amount of mRNA and gRNA, after formulating the LNP. One week following treatment, the mice were euthanized unless otherwise stated, and liver samples were obtained on necropsy and processed with the KingFisher Flex Purification System according to the manufacturer's instructions to isolate genomic DNA.

LNP treatment of NHPs. The NHP studies were approved by the Institutional Animal Care and Use Committees of Envol Biomedical and Altasciences, respectively. NHPs studies were performed at Envol Biomedical (study #VTP2001) and Altasciences (study #1388.02, 04, 05, 09, and 11), with both studies using *Macaca fascicularis*) of Cambodian origin. The animals were 2-3 years of age and 2-3 kilograms in weight at the time of study initiation. All the animals were genotyped at the PCSK9 and/or ANGPTL3 editing site(s) to ensure that any animals receiving LNPs were homozygous for the protospacer DNA sequences perfectly matching the gRNA sequence, and animals were randomly assigned to various experimental groups. The animals were premedicated with 1 mg/kg dexamethasone, 0.5 mg/kg famotidine, and 5 mg/kg diphenhydramine prior to LNP administration unless otherwise stated. The LNP were administered using a temporary catheter inserted into a peripheral vein connected to a primed infusion line, over the course of 1 hour (+/−5 minutes). Dose formulations were administered at a volume of 6 ml/kg, unless otherwise specified, and dosed at mg/kg corresponding to mg of total RNA per animal weight (kilogram). The dose is calculated based on total RNA that constitute the amount of mRNA and gRNA, after formulating the LNP. The appropriate volume based on the weight of the animal was delivered using an infusion pump. Control animals received phosphate-buffered saline instead of LNP under the same infusion conditions. When there are two LNPs constituted from amino lipid 1 and amino lipid 2 used in the same NHP study, the test articles are identified as LNP #1 and LNP #2 where mRNA and gRNA used for preparing these LNPs are the same. If there is only one LNP composition used in a study, the test article is identified as LNP For blood chemistry samples, animals were fasted for at least 4 hours before collection via peripheral venipuncture. NHP studies generally followed collection on the following schedule: day −10, day −7, day −5, day 1 (6 hours after LNP infusion), day 2, day 3, day 5, day 8, and day 15. In the long-term study, samples were also collected at day 21 and day 28 and have generally been collected every 2 weeks thereafter and analyzed by the study site for LDL cholesterol, HDL cholesterol, total cholesterol, triglycerides, AST, and ALT. For each analyte, the mean of the values at day −10, day −7, and day −5 were regarded as the baseline value. A portion of each blood sample was sent to the investigators for PCSK9 or ANGPTL3 protein measurement.

Analysis of cytokine levels. The serum cynomolgus IL-6, MCP-1 and IP-10 levels were determined by U-PLEX Biomarker Group 1 (NHP) Assays (Meso Scale Discovery, #K15068L-2) according to manufacturer's instruction. Briefly, U-PLEX (Meso Scale Discovery, #N05230) plate was incubated overnight at 4° C. with linker-coupled capture antibodies (MCP-1 antibody; Meso Scale Discovery, #C26UG-3, IL-6 antibody; Meso Scale Discovery, #C21TX-3, IP-10 antibody; Meso Scale Discovery, #C21UF-3). After 3 washes with PBS-T (PBS containing 0.05% Tween 20), test samples or Calibrator standards (Calibrator 1; Meso Scale Discovery, #C0060-2, Calibrator 2: Meso Scale Discovery, #C0061-2) were incubated with assay diluent 43 (Meso Scale Discovery, #$R^{50}$AG-2), which contains serum, blockers and preservatives, at room temperature for an hour. After 3 washes, SULFO-TAG conjugated detection antibodies for IL-6 (Meso Scale Discovery, #D26TX-3), MCP-1 (Meso Scale Discovery, #D26UG-3) and IP-10 (Meso Scale Discovery, #D21UF-3) were incubated in individual wells at room temperature for an hour. After 3 washes and adding Gold™ read buffer B (Meso Scale Discovery, #$R^{60}$AM-2) to each well, the plate was analyzed by MSD instrument (Meso Scale Discovery, #R31QQ-3.

Table 23. ABE Variant Sequences

---
Lengthy table referenced here

US12115230-20241015-T00001

Please refer to the end of the specification for access instructions.

---

Table 24. Guide RNA (SgRNA/gRNA) Sequences

---
Lengthy table referenced here

US12115230-20241015-T00002

Please refer to the end of the specification for access instructions.

---

All patents and publications mentioned in this specification are herein incorporated by reference to the same extent as if each independent patent and publication was specifically and individually indicated to be incorporated by reference.

OTHER EMBODIMENTS

From the foregoing description, it will be apparent that variations and modifications may be made to the disclosure described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment, any portion of the embodiment, or in combination with any other embodiments or any portion thereof.

As is set forth herein, it will be appreciated that the disclosure comprises specific embodiments and examples of base editing systems to effect a nucleobase alteration in a gene and methods of using same for treatment of disease including compositions that comprise such base editing systems, designs and modifications thereto; and specific examples and embodiments describing the synthesis, manufacture, use, and efficacy of the foregoing individually and in combination including as pharmaceutical compositions for treating disease and for in vivo and in vitro delivery of active agents to mammalian cells under described conditions.

While specific examples and numerous embodiments have been provided to illustrate aspects and combinations of aspects of the foregoing, it should be appreciated and understood that any aspect, or combination thereof, of an exemplary or disclosed embodiment may be excluded therefrom to constitute another embodiment without limitation and that it is contemplated that any such embodiment can constitute a separate and independent claim.

Similarly, it should be appreciated and understood that any aspect or combination of aspects of one or more embodiments may also be included or combined with any aspect or combination of aspects of one or more embodiments and that it is contemplated herein that all such combinations thereof fall within the scope of this disclosure and can be presented as separate and independent claims without limitation. Accordingly, it should be appreciated that any feature presented in one claim may be included in another claim; any feature presented in one claim may be removed from the claim to constitute a claim without that feature; and any feature presented in one claim may be combined with any feature in another claim, each of which is contemplated herein. The following enumerated clauses are further illustrative examples of aspects and combination of aspects of the foregoing embodiments and examples:

Following is the first example of enumerated clauses:

1. A composition for editing a gene target comprising:
   (i) a base editor fusion protein comprising a programmable DNA binding domain and a deaminase, or a mRNA encoding the same,
   (ii) a guide RNA comprising a tracr sequence that serves as a binding scaffold for the base editor fusion protein, and a spacer sequence that corresponds to a protospacer on a PCSK9 gene,
   wherein the guide RNA directs the base editor fusion protein to effect a nucleobase alteration in the PCSK9 gene in vivo when administered to a mammalian subject,
   wherein when the guide RNA and the mRNA is administered at a total amount of at least 0.05 mg/kg, the base alteration occurs in at least 35% of whole liver cells in the mammalian subject as measured by next generation sequencing or Sanger sequencing.

2. The composition of clause 1, wherein the mammalian subject is a cynomolgus monkey,
   wherein when the guide RNA and the mRNA is administered at a total amount of at least 0.5 mg/kg, the base alteration occurs in at least 40% of whole liver cells in the cynomolgus monkey as measured by next generation sequencing or Sanger sequencing.

3. The composition of clause 1, wherein the mammalian subject is a cynomolgus monkey,
   wherein when the guide RNA and the mRNA is administered at a total amount of at least 1 mg/kg, the base alteration occurs in at least 45% of whole liver cells in the cynomolgus monkey as measured by next generation sequencing or Sanger sequencing.

4. The composition of clause 1, wherein the mammalian subject is a cynomolgus monkey,
   wherein when the guide RNA and the mRNA is administered at a total amount of at least 1.5 mg/kg, the base alteration occurs in at least 50% of whole liver cells in the cynomolgus monkey as measured by next generation sequencing or Sanger sequencing.

5. The composition of clause 1, wherein the mammalian subject is a cynomolgus monkey,
   wherein when the guide RNA and the mRNA is administered at a total amount of at least 3 mg/kg, the base alteration occurs in at least 55% of whole liver cells in the cynomolgus monkey as measured by next generation sequencing or Sanger sequencing.

6. The composition of clause 1, wherein the mammalian subject is a mouse,
   wherein when the guide RNA and the mRNA is administered at a total amount of at least 0.125 mg/kg, the base alteration occurs in at least 40% of whole liver cells in the mouse as measured by next generation sequencing or Sanger sequencing.

7. The composition of clause 1, wherein the mammalian subject is a mouse,
   wherein when the guide RNA and the mRNA is administered at a total amount of at least 0.5 mg/kg, the base alteration occurs in at least 45% of whole liver cells in the mouse as measured by next generation sequencing or Sanger sequencing.

8. The composition of clause 1, wherein the mammalian subject is a mouse,
   wherein when the guide RNA and the mRNA is administered at a total amount of at least 2 mg/kg, the base alteration occurs in at least 50% of whole liver cells in the mouse as measured by next generation sequencing or Sanger sequencing.

9. The composition of clause 2, wherein the nucleobase alteration results in a reduction of at least 50% in blood low-density lipoprotein cholesterol (LDL-C) level in the subject as compared to prior to the administration.

10. The composition of any one of clauses 1-9, wherein the protospacer is located in a splice site.

11. The composition of any one of clauses 1-9, wherein the protospacer complementary sequence is in the antisense strand of the PCSK9 gene.

12. The composition of any one of clauses 1-9, wherein the protospacer complementary sequence is in the sense strand of the PCSK9 gene.

13. The composition of any one of clauses 1-12, wherein the base alteration happens outside of the protospacer on the PCSK9 gene (off-target sites),
   wherein the editing percentages of off-target sites set forth in Table 11 are below or equal to the editing percentages set forth in Table 11, respectively.

14. The composition of any one of clauses 1-13, wherein the deaminase is an adenine deaminase and wherein the nucleobase alteration is a A·T to G·C alteration.

15. The composition of any one of clauses 1-14, wherein the programmable DNA binding domain comprises a nuclease inactive Cas9 or a Cas9 nickase.

16. The composition of any one of clauses 1-15, wherein the nucleobase alteration is at a splice site of the PCSK9 gene.

17. The composition of clause 16, wherein the nucleobase alteration is at a splice donor site of the PCSK9 gene.

18. The composition of clause 17, wherein the splice donor site is at 5' end of PCSK9 intron 1 as referenced in SEQ ID NO: 5.

19. The composition of clause 16, wherein the nucleobase alteration is at a splice acceptor site of the PCSK9 gene.

20. The composition of any one of clauses 1-19, wherein the nucleobase alteration results in a frame shift, a premature stop codon, an insertion or deletion in a transcript encoded by the PCSK9 gene.

21. The composition of any one of clauses 1-20, wherein the nucleobase alteration results in an aberrant transcript encoded by the PCSK9 gene.

22. The composition of any one of clauses 1-21, wherein the guide RNA is chemically modified.

23. The composition of clause 16, wherein the tracr sequence of the guide RNA is chemically modified following the scheme depicted in FIG. 7.

24. The composition of any one of clauses 1-22, wherein the spacer sequence comprises a PCSK9 ABE guide RNA spacer sequence set forth in Table 1.

25. The composition of clause 24, wherein the guide RNA comprises the PCSK9 ABE guide RNA sequence of GA096, GA097, GA343, GA346, GA375-377, GA380-389, GA391, GA439 or GA440 as set forth in Table 1.

26. The composition of any one of clauses 1-23, wherein the protospacer sequence comprises a PCSK9 ABE protospacer sequence set forth in Table 1. 27. The composition of clause 26, wherein the protospacer comprises the sequence 5'—

```
                                      (SEQ ID No: 13)
CCCGCACCTTGGCGCAGCGG-3' or (SEQ ID No: 247)
5'-CCGCACCTTGGCGCAGCGG-3'.
```

28. The composition of any one of clauses 1-27, wherein the base editor fusion protein comprises an amino acid sequence of SEQ ID No: 2137.

29. The composition of any one of clauses 1-28, wherein the GC % content of the mRNA sequence is greater than 50%.

30. The composition of clause 29, wherein the GC % content of the mRNA sequence is greater than 56%.

31. The composition of clause 30, wherein the GC % content of the mRNA sequence is greater than or equal to 63%.

32. The composition of clause 29, wherein the mRNA comprises an adenine tTNA deaminase (TadA) region, a Cas9 region and a nuclear localization sequence (NLS) region.

33. The composition of clause 32, wherein the mRNA further comprises a first linker region which connects the TadA region and the Cas9 region, and a second linker region which connects the Cas9 region and the NLS region.

34. The composition of clause 32 or 33, wherein the GC % content of the TadA region is greater than 60%.

35. The composition of clause 32 or 33, wherein the GC % content of the TadA region is greater than or equal to 70%.

36. The composition of clause 32 or 33, wherein the GC % content of the Cas9 region is greater than 56%.

37. The composition of clause 32 or 33, wherein the GC % content of the Cas9 region is greater than or equal to 62%.

38. The composition of clause 32 or 33, wherein the GC % content of the NLS region is greater than 54%.

39. The composition of clause 32 or 33, wherein the GC % content of the NLS region is greater than or equal to 63%.

40. The composition of clause 33, wherein the GC % content of the first linker region is greater than 65%.

41. The composition of clause 33, wherein the GC % content of the first linker region is greater than or equal to 79%.

42. The composition of clause 33, wherein the GC % content of the second linker region is greater than 67%.

43. The composition of clause 33, wherein the GC % content of the second linker region is greater than or equal to 83%.

44. The composition of clause 33, wherein the GC % content of the TadA region is greater than 60%, the GC % content of the Cas9 region is greater than 56%, the GC % content of the NLS region is greater than 54%, the GC % content of the first linker region is greater than 65%, and the GC % content of the second linker region is greater than 67%.

45. The composition of clause 29, wherein the mRNA comprises a mRNA sequence selected from Table 23.

46. The composition of clause 45, wherein the mRNA comprises a mRNA sequence of SEQ ID No: 2136.

47. The composition of any one of clauses 29-46, wherein the mRNA comprises a poly A tail.

48. The composition of any one of clauses 1-47, further comprising a lipid nanoparticle (LNP) enclosing (i).

49. The composition of clause 48, wherein the LNP further encloses (ii).

50. The composition of clause 48, further comprising a second LNP enclosing (ii).

51. The composition of any one of clauses 1-44, wherein the ratio of the guide RNA and the mRNA encoding the base editor fusion protein is about 1:10 to about 10:1 by weight.

52. The composition of clause 51, wherein the ratio of the guide RNA and the mRNA encoding the base editor fusion protein is about 1:1, 1.5:1, 2:1, 3:1, 4:1, 1:1.5, 1:2, 1:3, or 1:4 by weight.

53. The composition of clause 51, wherein the ratio of the guide RNA and the mRNA encoding the base editor fusion protein is about 1:1 by weight.

54. A pharmaceutical composition comprising the composition of any one of the preceding clauses and a pharmaceutically acceptable carrier or excipient.

55. A method for treating or preventing a condition in a subject in need thereof, the method comprising administering to the subject a therapeutically effective amount of the composition of clause 1.

56. The method of clause 55, wherein the administration is via intravenous infusion.

57. The method of clause 55 or 56, comprising sequential administration of a LNP enclosing (i) and a LNP enclosing (ii).

58. The method of clause 55 or 56, comprising concurrent administration of the t LNP enclosing (i) and the LNP enclosing (ii).

59. The method of clause 57, comprising administering a single dose of the LNP enclosing (ii) followed by staggered doses of the LNP enclosing (i) over an interval of 1 day.

60. The method of clause 57, comprising administering a single dose of the LNP enclosing (ii) followed by staggered doses of the LNP enclosing (i) over an interval of 2 days.

61. The method of clause 57, comprising administering a single dose of the LNP enclosing (ii) followed by staggered doses of the LNP enclosing (i) over an interval of 3 days.

62. The method of clause 57, comprising administering a single dose of the LNP enclosing (ii) followed by staggered doses of the LNP enclosing (i) over an interval of 4 days.

63. The method of clause 57, comprising administering a single dose of the LNP enclosing (ii) followed by staggered doses of the LNP enclosing (i) over an interval of 5 days.

64. The method of clause 57, comprising administering a single dose of the LNP enclosing (ii) followed by staggered doses of the LNP enclosing (i) over an interval of 6 days.

65. The method of clause 57, comprising administering a single dose of the LNP enclosing (ii) followed by staggered doses of the LNP enclosing (i) over an interval of 7 days.

66. The method of clause 55 or 56, comprising administering a single dose of the LNP enclosing (i) and (ii).

67. The method of clause 66, wherein the single dose of the LNP is at about 0.3 to about 3 mg/kg.

68. The method of clause 66 or 67, comprising administering a treatment course of one or more treatments to the subject, wherein each one of the one or more treatment comprises one or more of the single doses of the LNP.

69. The method of clause 68, comprising administering a treatment course of two to ten treatments.

70. The method of clause 68, comprising administering a treatment course of two to five treatments.

71. The method of clause 68, comprising administering a treatment course of two treatments.

72. The method of clause 68, comprising administering a treatment course of three treatments.

73. The method of clause 68, comprising administering a treatment course of four treatments.

74. The method of clause 68, comprising administering a treatment course of five treatments.

75. The method of any one of clauses 55-74, wherein the condition is an atherosclerotic cardiovascular disease.

76. The method of any one of clauses 55-74, wherein the condition is an atherosclerotic vascular disease.

77. The method of any one of clauses 55-74, wherein the subject is a human.

78. A composition for editing a gene target comprising:
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a PCSK9 gene,
wherein the guide RNA directs the base editor fusion protein to effect a nucleobase alteration in the PCSK9 gene in vivo when administered to a mammalian subject, and
wherein the guide RNA comprises the PCSK9 ABE guide RNA sequences as set forth in Table 1.

79. A composition for editing a gene target comprising:
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a PCSK9 gene,
wherein the guide RNA directs the base editor fusion protein to effect a nucleobase alteration in the PCSK9 gene in vivo when administered to a mammalian subject, and
wherein the mRNA comprises a sequence selected from Table 23.

80. A method for treating or preventing an atherosclerotic cardiovascular disease in a subject in need thereof, the method comprising administering to the subject a therapeutically effective amount of a first composition, comprising
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a PCSK9 gene,
wherein the guide RNA directs the base editor fusion protein to effect a nucleobase alteration in the PCSK9 gene in vivo when administered to a mammalian subject,
wherein when the guide RNA and the mRNA is administered at a total amount of at least 0.05 mg/kg, the base alteration occurs in at least 35% of whole liver cells in the mammalian subject as measured by next generation sequencing or Sanger sequencing; and
a second composition, comprising
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a ANGPTL3 gene,
wherein the guide RNA directs the base editor fusion protein to effect a nucleobase alteration in the ANGPTL3 gene in vivo when administered to a mammalian subject,
wherein when the guide RNA and the mRNA is administered at a total amount of at least 0.5 mg/kg, the base alteration occurs in at least 35% of whole liver cells in the mammalian subject as measured by next generation sequencing or Sanger sequencing.

81. The method of clause 80, comprising sequential administration of the first composition and the second composition.

82. The method of clause 81, comprising administering one or more doses of the first composition followed by one or more dose of the second composition.

83. The method of clause 82, comprising administering one or more doses of the second composition followed by one or more dose of the first composition.

84. The method of clause 80, comprising concurrent administration of the first composition and the second composition.

85. The method of clause 84, comprising one or more doses of the first composition and the second composition.

86. A composition for editing a gene target comprising:
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a APOC3 gene,
wherein the guide RNA comprises the APOC3 ABE guide RNA sequence of GA300-303 as set forth in Table 24.

87. A composition for editing a gene target comprising:
(i) a base editor fusion protein comprising a programmable DNA binding domain and a deaminase, or a mRNA encoding the same, (ii) a guide RNA comprising a tracr sequence that serves as a binding scaffold for the base editor fusion protein, and a spacer sequence that corresponds to a protospacer on a PCSK9 gene,
wherein the guide RNA directs the base editor fusion protein to effect a nucleobase alteration in the PCSK9 gene in vitro,
wherein when the guide RNA and the mRNA is administered at a total amount of at least 2.5 mg/kg, the base alteration occurs in at least 35% of whole liver cells in the mammalian subject as measured by next generation sequencing or Sanger sequencing.

88. A composition for editing a PCSK9 gene comprising:
(a) a mRNA encoding an adenine base editor protein having an editing window, and
(b) a guide RNA comprising a tracr sequence that serves as a binding scaffold for the base editor protein and a spacer sequence that serves to guide the base editor protein to a protospacer sequence on the PCSK9 gene,
wherein the spacer sequence is complimentary, at least in part, to a splice site or an exon region of the PCSK9 gene.

89. The composition for editing the PCSK9 gene of clause 88, wherein when the base editor protein is operatively bound to the guide RNA and the guide RNA is hybridized with the complementary strand to the protospacer sequence on the PCSK9 gene, the editing window encompasses the splice site of the PCSK9 gene.

90. The composition for editing the PCSK9 gene of clause 88, wherein when the base editor protein is operatively bound to the guide RNA and the guide RNA is hybridized with the complementary strand to the protospacer sequence on the PCSK9 gene, the editing window encompasses a region of an intron of the PCSK9 gene.

91. The composition for editing the PCSK9 gene of clause 88, wherein when the base editor protein is operatively bound to the guide RNA and the guide RNA is hybridized with the complementary strand to the protospacer sequence on the PCSK9 gene, the editing window encompasses a region of intron 1, intron 3 or intron 4 of the PCSK9 gene.

92. The composition for editing the PCSK9 gene of clause 88, wherein when the base editor protein is operatively bound to the guide RNA and the guide RNA is hybridized with the complementary strand to the protospacer sequence on the PCSK9 gene, the editing window encompasses a region of intron 1 of the PCSK9 gene.

93. The composition for editing the PCSK9 gene of clause 88, wherein the spacer sequence has a 80-100% nucleotide sequence identity to a spacer sequence selected from the group of guide RNA sequences identified as GA066, GA073 and GA074.

94. The composition for editing the PCSK9 gene of clause 88, wherein the tracr sequence has a 80-100% nucleotide sequence identity to a tracr sequence selected from the group of guide RNA sequences identified as GA066, GA095, GA096, GA097, GA343, GA346, GA375, GA376, GA377, GA380, GA381, GA382, GA383, GA384, GA385, GA386, GA387, GA388, GA389, GA439, and GA440.

95. The composition for editing the PCSK9 gene of clause 88, wherein the mRNA has an 80-100% sequence identity to the mRNA sequences identified as MA002, MA004, MA040, MA0041, or MA045.

96. The composition for editing the PCSK9 gene of clause 88, wherein the mRNA has one or more of the GC nucleotide region percentages set forth in the following table:

| Nucleotide region | Average GC Nucleotide Content |
| --- | --- |
| 27-213 | 67-73% |
| 389-661 | 67-71% |
| 735-829 | 63-74% |
| 4207-4286 | 67-70% |
| 4537-4569 | 65-73% |
| 4683-4741 | 62-67% |

97. The composition for editing the PCSK9 gene of clause 88, wherein the mRNA has one or more of the GC nucleotide region percentages set forth in the following table:

| Nucleotide region | Average GC Nucleotide Content |
| --- | --- |
| 27-213 | At least 73% |
| 389-661 | At least 71% |
| 735-829 | At least 74% |
| 4207-4286 | At least 70% |
| 4537-4569 | At least 73% |
| 4683-4741 | At least 67% |

98. The composition for editing the PCSK9 gene of clause 88, wherein the mRNA and gRNA are encapsulated within a lipid nanoparticle.

99. The composition for editing the PCSK9 gene of clause 88, wherein the mRNA and gRNA are encapsulated within a lipid nanoparticle having the following: LNP composition (mol %):
40-65% iLipid
2-20% DSPC
1-5% PEG
Remaining mol % balance is cholesterol;
LNP Particle size: 55-120 nm Z average hydrodynamic diameter; and
Polydispersity index of <0.2 as determined by dynamic light scattering.

100. The composition for editing the PCSK9 gene of clause 88, wherein the mRNA and gRNA are encapsulated within the lipid nanoparticle having an LNP particle size between 50-70 nm Z average hydrodynamic diameter.

101. The composition for editing the PCSK9 gene of clause 88, wherein the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 40 percent.

102. The composition for editing the PCSK9 gene of clause 88, wherein the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 50 percent.

103. The composition for editing the PCSK9 gene of clause 88, wherein the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 30 percent.

104. The composition for editing the PCSK9 gene of clause 88, wherein the composition when administered to a group of cynomolgus monkeys via intravenous infusion at a dose of approximately 1 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 40 percent.

105. The composition for editing the PCSK9 gene of clause 88, wherein the composition when administered to a group of cynomolgus monkeys via intravenous infusion at a dose of approximately 1 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 50 percent.

106. The composition for editing the PCSK9 gene of clause 88, wherein the composition when administered to a group of cynomolgus monkeys via intravenous infusion at a dose of approximately 1 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 60 percent.

107. The composition for editing the PCSK9 gene of clause 88, wherein the composition when administered to a group of cynomolgus monkeys via intravenous infusion at a dose of approximately 1 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 70 percent.

108. The composition for editing the PCSK9 gene of clause 88, wherein the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 40 percent.

109. The composition for editing the PCSK9 gene of clause 88, wherein the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 50 percent.

110. The composition for editing the PCSK9 gene of clause 88, wherein the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 60 percent.

111. The composition for editing the PCSK9 gene of clause 88, wherein the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 70 percent.

112. The composition for editing the PCSK9 gene of clause 88, wherein the composition when at administered to a group of cynomolgus monkeys via intravenous infusion at a dose of approximately 1.5 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 80 percent.

113. The composition for editing the PCSK9 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 40 percent.

114. The composition for editing the PCSK9 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 50 percent.

115. The composition for editing the PCSK9 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 60 percent.

116. The composition for editing the PCSK9 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 70 percent.

117. The composition for editing the PCSK9 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the PCSK9 target splice site in the liver of the cynomolgus monkeys with an average editing percentage of greater than 80 percent.

118. The compositions for editing the PCSK9 gene of clauses 87-117, wherein the percent editing is determined at 15 days after dosing through analysis of dosed cynomolgus monkey liver either via liver biopsy or necropsy of the monkey.

119. The compositions for editing of the PCSK9 gene of clauses 87-117, wherein the percent editing is determined to be durably maintained by periodic liver biopsy testing of the dosed cynomolgus monkeys over a span of at least 168 days after dosing.

120. The compositions for editing of the PCSK9 gene of clauses 87-117, wherein the percent editing is determined to be durably maintained by periodic liver biopsy testing of the dosed cynomolgus monkeys over a span of at least 300 days after dosing.

121. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing PCSK9 protein in the plasma of the dosed cynomolgus monkeys on average of at least 35 percent as compared to baseline.

122. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing PCSK9 protein in the plasma of the dosed cynomolgus monkeys on average of at least 40 percent as compared to baseline.

123. The composition for editing the PCSK9 gene of clause 88, wherein the composition when administered to a group of cynomolgus monkeys via intravenous infusion at a dose of approximately 0.5 mg of the guide RNA and mRNA combined total weight per kg of monkey weight is capable of reducing PCSK9 protein in the plasma of the dosed cynomolgus monkeys on average of at least 50 percent as compared to baseline.

124. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing PCSK9 protein in the plasma of the dosed monkeys on average of at least 60 percent as compared to baseline.

125. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing PCSK9 protein in the plasma of the dosed cynomolgus monkeys on average of at least 70 percent as compared to baseline.

126. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing PCSK9 protein in the plasma of the dosed cynomolgus monkeys on average of at least 80 percent as compared to baseline.

127. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing PCSK9 protein in the plasma of the dosed cynomolgus monkeys on average of at least 35 percent as compared to baseline.

128. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing PCSK9 protein in the plasma of the dosed cynomolgus monkeys on average of at least 40 percent as compared to baseline.

129. The composition for editing the PCSK9 gene of clause 88, wherein the composition when administered to a group of cynomolgus monkeys via intravenous infusion at a dose of approximately 1 mg of the guide RNA and mRNA combined total weight per kg of monkey weight is capable of reducing PCSK9 protein in the plasma of the dosed cynomolgus monkeys on average of at least 50 percent as compared to baseline.

130. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing PCSK9 protein in the plasma of the dosed cynomolgus monkeys on average of at least 60 percent as compared to baseline.

131. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing PCSK9 protein in the plasma of the dosed cynomolgus monkeys on average of at least 70 percent as compared to baseline.

132. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing PCSK9 protein in the plasma of the dosed cynomolgus monkeys on average of at least 80 percent as compared to baseline.

133. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing PCSK9 protein in the plasma of the dosed cynomolgus monkeys on average of at least 35 percent as compared to baseline.

134. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing PCSK9 protein in the plasma of the dosed cynomolgus monkeys on average of at least 40 percent as compared to baseline.

135. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing PCSK9 protein in the plasma of the dosed cynomolgus monkeys on average of at least 50 percent as compared to baseline.

136. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing PCSK9 protein in the plasma of the dosed cynomolgus monkeys on average of at least 60 percent as compared to baseline.

137. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing PCSK9 protein in the plasma of the dosed cynomolgus monkeys on average of at least 70 percent as compared to baseline.

138. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing PCSK9 protein in the plasma of the dosed cynomolgus monkeys on average of at least 80 percent as compared to baseline.

139. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing PCSK9 protein in the plasma of the dosed cynomolgus monkeys on average of at least 35 percent as compared to baseline.

140. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing PCSK9 protein in the plasma of the dosed cynomolgus monkeys on average of at least 40 percent as compared to baseline.

141. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing PCSK9 protein in the plasma of the dosed cynomolgus monkeys on average of at least 50 percent as compared to baseline.

142. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing PCSK9 protein in the plasma of the dosed cynomolgus monkeys on average of at least 60 percent as compared to baseline.

143. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing PCSK9 protein in the plasma of the dosed cynomolgus monkeys on average of at least 70 percent as compared to baseline.

144. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing PCSK9 protein in the plasma of the dosed cynomolgus monkeys on average of at least 80 percent as compared to baseline.

145. The compositions for editing of the PCSK9 gene of clauses 121-144, wherein the reduction in plasma protein is determined at 15 days after dosing via blood sampling and analysis of the dosed cynomolgus monkey.

146. The composition for editing the PCSK9 gene of clause 88, wherein the composition when administered to a group of cynomolgus monkeys via intravenous infusion at a dose of approximately 0.5 mg of the guide RNA and mRNA combined total weight per kg of monkey weight is capable of reducing LDL-C in the plasma of the dosed monkeys on average of at least 20 percent as compared to baseline.

147. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing LDL-C in the plasma of the dosed cynomolgus monkeys on average of at least 25 percent as compared to baseline.

148. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing LDL-C in the plasma of the dosed cynomolgus monkeys on average of at least 30 percent as compared to baseline.

149. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing LDL-C in the plasma of the dosed cynomolgus monkeys on average of at least 35 percent as compared to baseline.

150. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing LDL-C in the plasma of the dosed cynomolgus monkeys on average of at least 40 percent as compared to baseline.

151. The composition for editing the PCSK9 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing LDL-C in the plasma of the dosed cynomolgus monkeys on average of at least 45 percent as compared to baseline.

152. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 20 percent as compared to baseline.

153. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 25 percent as compared to baseline.

154. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 30 percent as compared to baseline.

155. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 35 percent as compared to baseline.

156. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 40 percent as compared to baseline.

157. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 45 percent as compared to baseline.

158. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 50 percent as compared to baseline.

159. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 55 percent as compared to baseline.

160. The composition for editing the PCSK9 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing LDL-C in the plasma of the dosed cynomolgus monkeys on average of at least 60 percent as compared to baseline.

161. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 20 percent as compared to baseline.

162. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 25 percent as compared to baseline.

163. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 30 percent as compared to baseline.

164. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 35 percent as compared to baseline.

165. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 40 percent as compared to baseline.

166. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 45 percent as compared to baseline.

167. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 50 percent as compared to baseline.

168. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 55 percent as compared to baseline.

169. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 60 percent as compared to baseline.

170. The composition for editing the PCSK9 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing LDL-C in the plasma of the dosed cynomolgus monkeys on average of at least 65 percent as compared to baseline.

171. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 20 percent as compared to baseline.

172. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 25 percent as compared to baseline.

173. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 30 percent as compared to baseline.

174. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 35 percent as compared to baseline.

175. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 40 percent as compared to baseline.

176. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 45 percent as compared to baseline.

177. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 50 percent as compared to baseline.

178. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 55 percent as compared to baseline.

179. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 60 percent as compared to baseline.

180. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing LDL-C in the plasma of the dosed cynomolgus monkeys on average of at least 65 percent as compared to baseline.

181. The compositions for editing the PCSK9 gene of clauses 148-182, wherein the reduction in LDL-C is determined at 15 days after dosing via blood sampling and analysis of the dosed cynomolgus monkey.

182. The compositions for editing the PCSK9 gene of clauses 148-182, wherein the reduction in LDL-C is determined to be durably maintained over a span of at least 168 days by periodic blood sampling and analysis of the dosed cynomolgus monkey.

183. The compositions for editing the PCSK9 gene of clauses 148-182, wherein the reduction in LDL-C is determined to be durably maintained over a span of at least 300 days by periodic blood sampling and analysis of the dosed cynomolgus monkey.

184. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) in the plasma of the dosed cynomolgus monkeys on average of at least 10 percent as compared to baseline.

185. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 15 percent as compared to baseline.

186. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 20 percent as compared to baseline.

187. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 25 percent as compared to baseline.

188. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 30 percent as compared to baseline.

189. The composition for editing the PCSK9 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of approximately 35 percent as compared to baseline.

190. The compositions for editing the PCSK9 gene of clauses 186-191, wherein the reduction in lipoprotein(a) is determined at 15 days after dosing via blood sampling and analysis of the dosed cynomolgus monkey.

191. The compositions for editing the PCSK9 gene of clauses 186-191, wherein the reduction in lipoprotein(a) is determined to be durably maintained over a span of at least 224 days by periodic blood sampling and analysis of the dosed cynomolgus monkey.

192. The compositions for editing the PCSK9 gene of clauses 186-191, wherein the reduction in lipoprotein(a) is determined to be durably maintained over a span of at least 300 days by periodic blood sampling and analysis of the dosed cynomolgus monkey.

193. The compositions for editing the PCSK9 gene of clauses 101-194, wherein to the extent that the dosing of the cynomolgus monkeys results in elevation of AST, ALT, or Cytokines, the elevations resulting from the dosing of the composition are transient and resolved back to approximately baseline levels within 3-15 days after dosing.

194. The composition for editing the PCSK9 gene of clauses 101-103, 121-126, 148-153, wherein the percent editing of PCSK9 is negligible outside of the liver, spleen and adrenal glands tissues as illustrated in FIG. 27.

195. The compositions for editing the PCSK9 gene of clauses 101-107, 121-132, 148-162, wherein repeat dosing results is additive with respect to the editing percentage of PCSK9 editing percentage.

196. The compositions for editing the PCSK9 gene of clause 195, wherein the repeat dosing does not elicit cytokine activation nor an immune response.

197. The composition for editing the PCSK9 gene of clause 88, wherein the spacer sequence has at least 80% nucleotide correlation with the nucleotide sequence of a targeted protospacer on the PCSK9 gene, wherein an RNA nucleotide on the spacer sequence is in correlation with a DNA nucleotide of the protospacer if it has the same nucleotide as the DNA nucleotide in the same order and wherein uracil and thymine bases are considered the same nucleotide for purposes of determining correlation.

198. The composition for editing the PCSK9 gene of clause 197, wherein the spacer sequence has at least 85% nucleotide correlation with the nucleotide sequence of a targeted protospacer on the PCSK9 gene.

199. The composition for editing the PCSK9 gene of clause 197, wherein the spacer sequence has at least 90% nucleotide correlation with the nucleotide sequence of a targeted protospacer on the PCSK9 gene.

200. The composition for editing the PCSK9 gene of clause 197, wherein the spacer sequence has at least 95% nucleotide correlation with the nucleotide sequence of a targeted protospacer on the PCSK9 gene.

201. The composition for editing the PCSK9 gene of clause 197, wherein the spacer sequence has at least 99% nucleotide correlation with the nucleotide sequence of a targeted protospacer on the PCSK9 gene.

202. The composition for editing the PCSK9 gene of clause 197, wherein the spacer sequence has at least 100% nucleotide correlation with the nucleotide sequence of a targeted protospacer on the PCSK9 gene.

203. A method for treating or preventing an atherosclerotic cardiovascular disease in a subject in need thereof, the method comprising administering to the subject a therapeutically effective amount of
  (a) a mRNA encoding an adenine base editor protein having an editing window,
  (b) a first guide RNA comprising a tracr sequence that serves as a binding scaffold for the base editor protein and a spacer sequence that serves to guide the base editor protein to a protospacer sequence on a PCSK9 gene, wherein the spacer sequence is complimentary, at least in part, to a splice site or an exon region of the PCSK9 gene; and
  (c) a second guide RNA comprising a tracr sequence that serves as a binding scaffold for the base editor protein and a spacer sequence that serves to guide the base editor protein to a protospacer sequence on a ANGPTL3 gene, wherein the spacer sequence is complimentary, at least in part, to a splice site or an exon region of the ANGPTL3 gene.

204. The method of clause 203, further comprising a first LNP enclosing (a).

205. The method of clause 204, wherein the first LNP encloses (b) and (c).

206. The method of clause 204, wherein the first LNP was administered repeatedly.

207. The method of clause 204, wherein the first LNP was administered repeatedly at an interval of one to sixty days.

208. The method of clause 204, wherein the first LNP was administered repeatedly at an interval of seven days.

209. The method of clause 204, wherein the first LNP further encloses (b).

210. The method of clause 209, further comprising a second LNP enclosing (a) and (c).

211. The method of clause 210, wherein the first LNP and the second LNP are administered sequentially.

212. The method of clause 211, wherein the first LNP and the second LNP are administered sequentially at an interval of one day to 12 months.

213. The method of clause 212, wherein the interval is one day.

214. The method of clause 212, wherein the interval is five days.

215. The method of clause 212, wherein the interval is ten days.

216. The method of clause 212, wherein the interval is fifteen days.

217. The method of clause 212, wherein the interval is twenty days.

218. The method of clause 212, wherein the interval is twenty-five days.

219. The method of clause 212, wherein the interval is one month.

220. The method of clause 212, wherein the interval is two months.

221. The method of clause 212, wherein the interval is three months.

222. The method of clause 212, wherein the interval is five months.

223. The method of clause 212, wherein the interval is eight months.

224. The method of clause 212, wherein the interval is ten months.

225. The method of clause 212, wherein the interval is twelve months.

Following is the second example of enumerated clauses:

1. A single guide RNA that comprises: (a) a spacer sequence, wherein the spacer sequence comprises (i) one or more chemical modification(s) and (ii) one or more unmodified nucleotide(s) at select position(s), and (b) a tracr sequence having at least 70% identity to SEQ ID NO: 61, wherein the tracr sequence serve as a binding scaffold for a Type II Cas protein, and wherein the tracr sequence comprises (i) one or more chemical modification(s) and (ii) one or more unmodified nucleotide(s) at select position(s).

2. The single guide RNA of clause 1, wherein the spacer sequence hybridizes with a target polynucleotide sequence in a gene of interest when contacted with the target polynucleotide sequence, wherein the single guide RNA directs the Cas protein to effect alteration in the gene when administered to a mammalian subject.

3. The single guide RNA of clause 1 or 2, wherein the tracr sequence comprises unmodified nucleotides at positions 2 to 7, 23 to 25, 27, 29, 31, 38, 39, 42 to 45 48, 49 and 62 as numbered in SEQ ID NO: 61 or a corresponding position thereof.

4. The single guide RNA of clause 1 or 2, wherein the tracr sequence comprises unmodified nucleotides at positions 2 to 7, 13, 23 to 25, 27, 29, 31, 38, 39, 42 to 45, 48, 49, 53 and 62 as numbered in SEQ ID NO: 61 or a corresponding position thereof.

5. The single guide RNA of clause 1 or 2, wherein the tracr sequence comprises unmodified nucleotides at positions 2 to 7, 13, 23 to 25, 27, 29, 31, 38, 39, 42 to 45, 48, 49, 53, 61, 68, 70 and 11 as numbered in SEQ ID NO: 61 or a corresponding position thereof.

6. The single guide RNA of any one of clauses 1 to 3, wherein the tracr sequence comprises modified nucleotides at positions 1, 8 to 22, 26, 28, 30, 32 to 37, 40, 41, 46, 47, 50 to 61, and 63 to 80 as numbered in SEQ ID NO: 61 or a corresponding position thereof.

7. The single guide RNA of any one of clauses 1 to 3, wherein the tracr sequence comprises modified nucleotides at positions 1, 8 to 12, 14 to 22, 26, 28, 30, 32 to 37, 40, 41, 46, 47, 50 to 52, 54 to 61, and 63 to 80 as numbered in SEQ ID NO: 61 or a corresponding position thereof.

8. The single guide RNA of any one of clauses 1 to 7, wherein the tracr sequence comprises modified nucleotides at positions 1, 8 to 12, 14 to 22, 26, 28, 30, 32 to 34, 37, 41, 46, 47, 50 to 52, 54 to 60, 62 to 67, 69 and 72 to 80 as numbered in SEQ ID NO: 61 or a corresponding position thereof.

9. The single guide RNA of any one of clauses 3 to 8, wherein more than 60% of the nucleotides in the tracr sequence with SEQ ID NO: 61 are modified.

10. The single guide RNA of clauses 9, wherein more than 70% of the nucleotides in the tracr sequence with SEQ ID NO: 61 are modified.

11. The single guide RNA of any one of clauses 1 to 10, wherein the tracr sequence comprises unmodified nucleotides at positions 13, 49, 53 and 62 as numbered in SEQ ID NO: 61 or a corresponding position thereof.

12. The single guide RNA of any one of clauses 11, wherein the tracr sequence comprises unmodified nucleotides at positions 49 and 62 as numbered in SEQ ID NO: 61 or a corresponding position thereof.

13. The single guide RNA of any one of clauses 1 to 10, wherein the tracr sequence comprises unmodified nucleotides at positions 13, 40, 49, 53, 61, 68, 70 and 71 as numbered in SEQ ID NO: 61 or a corresponding position thereof.

14. The single guide RNA of any one of clause 13, wherein the tracr sequence comprises unmodified nucleotides at positions 13, 49 and 53 as numbered in SEQ ID NO: 61 or a corresponding position thereof.

15. The single guide RNA of any one of clauses 1 to 10, wherein the tracr sequence comprises modified nucleotides at positions 1, 8, 21, 22, 26, 28, 30, 32 to 37, 40, 41, 46 and 47 as numbered in SEQ ID NO: 61 or a corresponding position thereof.

16. The single guide RNA of any one of clauses 1-15, wherein the tracr sequence comprises at least 80% identity to SEQ ID NO: 61.

17. The single guide RNA of any one of clauses 1-15, wherein the tracr sequence comprises at least 90% identity to SEQ ID NO: 61.

18. The single guide RNA of any one of clauses 1-17, wherein the chemical modification comprises a 2'-OMe modification.

19. The single guide RNA of any one of clauses 1-17, wherein the chemical modification comprises a nebularin or a deoxynebularin.

20. The single guide RNA of any one of clauses 1-17, wherein the chemical modification comprises a phosphorothioate linkage.

21. The single guide RNA of any one of clauses 1-20, wherein the tracr sequence comprises SEQ ID No. 61, and wherein the single guide RNA further comprises one or more phosphorothioate linkage at a 5' end, at a 3' end, at select internal positions or any combinations thereof.

22. The single guide RNA of clause 21, wherein the single guide RNA further comprises two and no more than two contiguous phosphorothioate linkages at the 5' end, at the 3' end or both.

23. The single guide RNA of clause 21, wherein the single guide RNA further comprises three contiguous phosphorothioate linkages at the 5' end, at the 3' end or both.

24. The single guide RNA of any one of clauses 1-21, wherein the single guide RNA comprises the sequence 5'-ususuNNN-3' at the 3'end, wherein N independently indicates a unmodified ribonucleotide, and wherein each u indicates 2'-O-methyluridine and each s indicates phosphorothioate linkage.

25. The single guide RNA of clauses 24, wherein each N is uridine.

26. The single guide RNA of any one of clauses 1-21, wherein the single guide RNA comprises the sequence 5'-ususuNNn-3' at the 3'end, wherein each N independently indicates a unmodified ribonucleotide, wherein the n indicates a modified nucleotide, wherein each u indicates 2'-O-methyluridine and wherein each s indicates phosphorothioate linkage.

27. The single guide RNA of clauses 26, wherein each N is uridine and the n is 2'-O-methyluridine.

28. A single guide RNA that comprises (i) a spacer sequence and (ii) a tracr sequence, wherein the spacer sequence hybridizes with a target polynucleotide sequence in a PCSK9 gene or an ANGPTL3 gene when contacted with the target polynucleotide sequence, wherein the tracr sequence binds a Type II Cas protein when contacted with the Type II Cas protein, and wherein the single guide RNA comprises a nebularine, a deoxynebularine, or a 2'-O-methylnebularine.

29. A single guide RNA that comprises (i) a spacer sequence and (ii) a tracr sequence, wherein the spacer sequence hybridizes with a target polynucleotide sequence in a PCSK9 gene or an ANGPTL3 gene when contacted with the target polynucleotide sequence, wherein the tracr sequence binds a Type II Cas protein when contacted with the Type II Cas protein, and wherein the single guide RNA comprises two and no more than two phosphorothioate linkages at a 5' end or at a 3' end.

30. The single guide RNA of clause 29, wherein the single guide RNA comprises two and no more than two phosphorothioate linkages at the 5' end and at the 3' end.

31. The single guide RNA of clause 29, wherein the single guide RNA comprises three phosphorothioate linkages at the 5' end.

32. The single guide RNA of clause 29, wherein the single guide RNA comprises three phosphorothioate linkages at the 3' end.

33. The single guide RNA of clause 29, wherein the two phosphorothioate linkages at the 5' end are two contiguous phosphorothioate linkages at the first two nucleotide positions of the 5' end.

34. The single guide RNA of clause 29, wherein the two phosphorothioate linkages at the 5' end are within the first 3-10 nucleotides of the 5' end.

35. The single guide RNA of clause 29, wherein the two phosphorothioate linkages at the 3' end are two contiguous phosphorothioate linkages at the last two nucleotide positions of the 3' end.

36. The single guide RNA of clause 29, wherein the two phosphorothioate linkages at the 3' end are within the last 3-10 nucleotides of the 3' end.

37. The single guide RNA of clause 29 comprising the sequence 5'-UsUsUs-3' at the 3' end, wherein U indicates a uridine and s indicates a phosphorothioate linkage.

38. The single guide RNA of clause 29 comprising the sequence 5'-UUU-3' at the 3'end.

39. The single guide RNA of any one of clauses 1-27, wherein the tracr sequence binds the Type II Cas protein with increased binding affinity compared to a tracr sequence in an unmodified single guide RNA.

40. The single guide RNA of any one of clauses 28-38, wherein the Type II Cas protein is a Cas9 protein.

41. The single guide RNA of clause 40, wherein the Cas9 protein is a *Streptococcus pyogenes* Cas9.

42. A single guide RNA that comprises a guide RNA sequence selected from Table 1, wherein a, u, g, and c indicate 2'-OMe modified adenine, uridine, guanine, and cytidine, wherein s indicates a phosphorothioate linkage, wherein X indicates a nebularine, wherein x indicates a 2'-O-methylnebularine and wherein dX indicates a 2'-deoxynebularine.

43. A pharmaceutical composition for gene modification comprising the single guide RNA of any one of clauses 1-42 and a Type II Cas protein or a nucleic acid sequence encoding the Type II Cas protein.

44. The pharmaceutical composition of clause 43 further comprising a vector that comprises the nucleic acid sequence encoding the Type II Cas protein.

45. The pharmaceutical composition of clause 43 or 44, wherein the Type II Cas protein is a Cas9.

46. The pharmaceutical composition of any one of clauses 43-45 further comprising a pharmaceutically acceptable carrier.

47. A lipid nanoparticle comprising the pharmaceutical composition of any one of clauses 43-46.

48. A method for modifying a target polynucleotide sequence in a cell comprising introducing into the cell the pharmaceutical composition of any one of clauses 43-46, wherein the single guide RNA directs the Type II Cas protein to effect a modification in the target polynucleotide sequence in the cell.

49. The method of clause 48, wherein the target polynucleotide sequence is in a PCSK9 gene.

50. The method of clause 49, wherein the modification reduces expression of functional PCSK9 protein encoded by the PCSK9 gene in the cell.

51. The method of clause 50, wherein the target polynucleotide sequence is in an ANGPTL3 gene.

52. The method of clause 51 wherein the modification reduces expression of functional ANGPTL3 protein encoded by the ANGPTL3 gene in the cell.

53. The method of any one of clauses 48-52, wherein the introduction is performed via a lipid nanoparticle that comprises the composition.

54. A method for treating or preventing a condition in a subject in need thereof, the method comprising administering to the subject the pharmaceutical composition of any one of clauses 43-46 or the lipid nanoparticle of clause 47, wherein the single guide RNA directs the Type II Cas protein to effect a modification in a target polynucleotide sequence in a cell of the subject, thereby treating or preventing the condition.

55. The method of clause 54, wherein the target polynucleotide sequence is in a PCSK9 gene.

56. The method of clause 54, wherein the target polynucleotide sequence is in an ANGPTL3 gene.

57. The method of clause 55, wherein the modification reduces expression of functional PCSK9 protein encoded by the PCSK9 gene in the subject.

58. The method of clause 56, wherein the modification reduces expression of functional ANGPTL3 protein encoded by the ANGPTL3 gene in the subject.

59. The method of any one of clauses 48-58 wherein the condition is an atherosclerotic vascular disease.

60. The method of any one of clauses 48-58, wherein the condition is an atherosclerotic vascular disease, hypertriglyceridemia, or diabetes.

61. The method of any one of clauses 48-60, wherein the subject exhibits a reduced blood LDL cholesterol level, and/or a reduced blood triglycerides level as compared to before the administration.

Following is the third example of enumerated clauses:

1. A composition for editing a gene target comprising:
   (i) a base editor fusion protein comprising a programmable DNA binding domain and a deaminase, or a mRNA encoding the same,
   (ii) a guide RNA comprising a tracr sequence that serves as a binding scaffold for the base editor fusion protein, and a spacer sequence that corresponds to a protospacer on a ANGPTL3 gene,
   wherein the guide RNA directs the base editor fusion protein to effect a nucleobase alteration in the ANGPTL3 gene in vivo when administered to a mammalian subject,
   wherein when the guide RNA and the mRNA is administered at a total amount of at least 0.5 mg/kg, the base alteration occurs in at least 35% of whole liver cells in the mammalian subject as measured by next generation sequencing or Sanger sequencing.

2. The composition of clause 1, wherein the mammalian subject is a cynomolgus monkey,
wherein when the guide RNA and the mRNA is administered at a total amount of about 1 mg/kg, the base alteration occurs in at least 35% of whole liver cells in the cynomolgus monkey as measured by next generation sequencing or Sanger sequencing.

3. The composition of clause 1, wherein the mammalian subject is a cynomolgus monkey,
wherein when the guide RNA and the mRNA is administered at a total amount of about 3 mg/kg, the base alteration occurs in at least 50% of whole liver cells in the cynomolgus monkey as measured by next generation sequencing or Sanger sequencing.

4. The composition of clause 2, wherein the nucleobase alteration results in a reduction of at least 20% in blood triglyceride level in the cynomolgus monkey as compared to prior to the administration.

5. The composition of clause 3, wherein the nucleobase alteration results in a reduction of at least 50% in blood triglyceride level in the cynomolgus monkey as compared to prior to the administration.

6. The composition of any one of clauses 1-5, wherein the protospacer is located in a splice site.

7. The composition of any one of clauses 1-5, wherein the protospacer complementary sequence is in the antisense strand of the ANGPTL3 gene.

8. The composition of any one of clauses 1-5, wherein the protospacer complementary sequence is in the sense strand of the ANGPTL3 gene.

9. The composition of any one of clauses 1-8, wherein the base alteration happens outside of the protospacer on the ANGPTL3 gene (off-target sites),
wherein the editing percentages of off-target sites set forth in Table 14 are below or equal to the editing percentages set forth in Table 14, respectively.

10. The composition of any one of clauses 1-9, wherein the deaminase is an adenine deaminase and wherein the nucleobase alteration is a A·T to G·C alteration.

11. The composition of any one of clauses 1-10, wherein the programmable DNA binding domain comprises a nuclease inactive Cas9 or a Cas9 nickase.

12. The composition of any one of clauses 1-11, wherein the nucleobase alteration is at a splice site of the ANGPTL3 gene.

13. The composition of clause 12, wherein the nucleobase alteration is at a splice donor site of the ANGPTL3 gene.

14. The composition of clause 13, wherein the splice donor site is at 5' end of ANGPTL3 intron 6 as referenced in SEQ ID NO: 7.

15. The composition of clause 12, wherein the nucleobase alteration is at a splice acceptor site of the ANGPTL3 gene.

16. The composition of any one of clauses 1-15, wherein the nucleobase alteration results in a frame shift, a premature stop codon, an insertion or deletion in a transcript encoded by the ANGPTL3 gene.

17. The composition of any one of clauses 1-16, wherein the nucleobase alteration results in an aberrant transcript encoded by the ANGPTL3 gene.

18. The composition of any one of clauses 1-17, wherein the guide RNA is chemically modified.

19. The composition of clause 16, wherein the tracr sequence of the guide RNA is chemically modified following the scheme depicted in FIG. 7.

20. The composition of any one of clauses 1-19, wherein the spacer sequence comprises an ANGPTL3 ABE guide RNA spacer sequence set forth in Table 1.

21. The composition of clause 20, wherein the guide RNA comprises the ANGPTL3 ABE guide RNA sequence of GA067, GA091, GA098, GA099, GA100, GA101, GA102, GA103, GA347, GA441, GA442, GA472, GA473, GA474, GA475, GA476, GA517 or GA547 as set forth in Table 1.

22. The composition of any one of clauses 1-19, wherein the protospacer sequence comprises an ANGPTL3 ABE protospacer sequence set forth in Table 1.

23. The composition of clause 22, wherein the protospacer comprises the sequence 5'-

(SEQ ID No: 14)
AAGATACCTGAATAACTCTC-3', (SEQ ID No: 15)
5'-AAGATACCTGAATAACCCTC-3', (SEQ ID No: 1606)
5'-GATACCTGAATAACTCTC-3', (SEQ ID No: 248)
5'-AGATACCTGAATAACCCTC-3', or (SEQ ID NO: 249)
5'-GATACCTGAATAACCCTC-3'.

24. The composition of any one of clauses 1-23, wherein the base editor fusion protein comprises an amino acid sequence of SEQ ID No: 2137.

25. The composition of any one of clauses 1-24, wherein the GC % content of the mRNA sequence is greater than 50%.

26. The composition of clause 25, wherein the GC % content of the mRNA sequence is greater than 56%.

27. The composition of clause 26, wherein the GC % content of the mRNA sequence is greater than or equal to 63%.

28. The composition of clause 25, wherein the mRNA comprises an adenine tTNA deaminase (TadA) region, a Cas9 region and a nuclear localization sequence (NLS) region.

29. The composition of clause 28, wherein the mRNA further comprises a first linker region which connects the TadA region and the Cas9 region, and a second linker region which connects the Cas9 region and the NLS region.

30. The composition of clause 28 or 29, wherein the GC % content of the TadA region is greater than 60%.

31. The composition of clause 28 or 29, wherein the GC % content of the TadA region is greater than or equal to 70%.

32. The composition of clause 28 or 29, wherein the GC % content of the Cas9 region is greater than 56%.

33. The composition of clause 28 or 29, wherein the GC % content of the Cas9 region is greater than or equal to 62%.

34. The composition of clause 28 or 29, wherein the GC % content of the NLS region is greater than 54%.

35. The composition of clause 28 or 29, wherein the GC % content of the NLS region is greater than or equal to 63%.

36. The composition of clause 29, wherein the GC % content of the first linker region is greater than 65%.

37. The composition of clause 29, wherein the GC % content of the first linker region is greater than or equal to 79%.

38. The composition of clause 29, wherein the GC % content of the second linker region is greater than 67%.

39. The composition of clause 29, wherein the GC % content of the second linker region is greater than or equal to 83%.

40. The composition of clause 29, wherein the GC % content of the TadA region is greater than 60%, the GC % content of the Cas9 region is greater than 56%, the GC % content of the NLS region is greater than 54%, the GC % content of the first linker region is greater than 65%, and the GC % content of the second linker region is greater than 67%.

41. The composition of clause 25, wherein the mRNA comprises a mRNA sequence selected from Table 23.

42. The composition of clause 41, wherein the mRNA comprises a mRNA sequence of SEQ ID No: 2136.

43. The composition of any one of clauses 25-42, wherein the mRNA comprises a poly A tail.

44. The composition of any one of clauses 1-43, further comprising a lipid nanoparticle (LNP) enclosing (i).

45. The composition of clause 44, wherein the LNP further encloses (ii).

46. The composition of clause 44, further comprising a second LNP enclosing (ii).

47. The composition of any one of clauses 1-44, wherein the ratio of the guide RNA and the mRNA encoding the base editor fusion protein is about 1:10 to about 10:1 by weight.

48. The composition of clause 47, wherein the ratio of the guide RNA and the mRNA encoding the base editor fusion protein is about 1:1, 1.5:1, 2:1, 3:1, 4:1, 1:1.5, 1:2, 1:3, or 1:4 by weight.

49. The composition of clause 48, wherein the ratio of the guide RNA and the mRNA encoding the base editor fusion protein is about 1:1 by weight.

50. A pharmaceutical composition comprising the composition of any one of the preceding clauses and a pharmaceutically acceptable carrier or excipient.

51. A method for treating or preventing a condition in a subject in need thereof, the method comprising administering to the subject a therapeutically effective amount of the composition of clause 1.

52. The method of clause 51, wherein the administration is via intravenous infusion.

53. The method of clause 51 or 52, comprising sequential administration of a LNP enclosing (i) and a LNP enclosing (ii).

54. The method of clause 51 or 52, comprising concurrent administration of the LNP enclosing (i) and the LNP enclosing (ii).

55. The method of clause 53, comprising administering a single dose of the LNP enclosing (ii) followed by staggered doses of the LNP enclosing (i) over an interval of 1 day.

56. The method of clause 53, comprising administering a single dose of the LNP enclosing (ii) followed by staggered doses of the LNP enclosing (i) over an interval of 2 days.

57. The method of clause 53, comprising administering a single dose of the LNP enclosing (ii) followed by staggered doses of the LNP enclosing (i) over an interval of 3 days.

58. The method of clause 53, comprising administering a single dose of the LNP enclosing (ii) followed by staggered doses of the LNP enclosing (i) over an interval of 4 days.

59. The method of clause 53, comprising administering a single dose of the LNP enclosing (ii) followed by staggered doses of the LNP enclosing (i) over an interval of 5 days.

60. The method of clause 53, comprising administering a single dose of the LNP enclosing (ii) followed by staggered doses of the LNP enclosing (i) over an interval of 6 days.

61. The method of clause 53, comprising administering a single dose of the LNP enclosing (ii) followed by staggered doses of the LNP enclosing (i) over an interval of 7 days.

62. The method of clause 51 or 52, comprising administering a single dose of the LNP enclosing (i) and (ii).

63. The method of clause 62, wherein the single dose of the LNP is at about 0.3 to about 3 mg/kg.

64. The method of clause 62 or 63, comprising administering a treatment course of one or more treatments to the subject, wherein each one of the one or more treatment comprises one or more of the single doses of the LNP.

65. The method of clause 64, comprising administering a treatment course of two to ten treatments.

66. The method of clause 64, comprising administering a treatment course of two to five treatments.

67. The method of clause 64, comprising administering a treatment course of two treatments.

68. The method of clause 64, comprising administering a treatment course of three treatments.

69. The method of clause 64, comprising administering a treatment course of four treatments.

70. The method of clause 62, comprising administering a treatment course of five treatments.

71. The method of any one of clauses 51-70, wherein the condition is an atherosclerotic cardiovascular disease.

72. The method of any one of clauses 51-70, wherein the condition is an atherosclerotic vascular disease.

73. The method of any one of clauses 51-72, wherein the subject is a human.

74. A composition for editing a gene target comprising:
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a ANGPTL3 gene,
wherein the guide RNA directs the base editor fusion protein to effect a nucleobase alteration in the ANGPTL3 gene in vivo when administered to a mammalian subject, and
wherein the guide RNA comprises the ANGPTL3 ABE guide RNA sequences as set forth in Table 1.

75. A composition for editing a gene target comprising:
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a ANGPTL3 gene,
wherein the guide RNA directs the base editor fusion protein to effect a nucleobase alteration in the ANGPTL3 gene in vivo when administered to a mammalian subject, and
wherein the mRNA comprises a sequence selected from Table 23.

76. A method for treating or preventing an atherosclerotic cardiovascular disease in a subject in need thereof, the method comprising administering to the subject a therapeutically effective amount of a first composition, comprising
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a PCSK9 gene,
wherein the guide RNA directs the base editor fusion protein to effect a nucleobase alteration in the PCSK9 gene in vivo when administered to a mammalian subject,
wherein when the guide RNA and the mRNA is administered at a total amount of at least 0.5 mg/kg, the base alteration occurs in at least 35% of whole liver cells in the mammalian subject as measured by next generation sequencing or Sanger sequencing; and a second composition, comprising
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a ANGPTL3 gene,
wherein the guide RNA directs the base editor fusion protein to effect a nucleobase alteration in the ANGPTL3 gene in vivo when administered to a mammalian subject,
wherein when the guide RNA and the mRNA is administered at a total amount of at least 1 mg/kg, the base alteration occurs in at least 35% of whole liver cells in the mammalian subject as measured by next generation sequencing or Sanger sequencing.

77. The method of clause 76, comprising sequential administration of the first composition and the second composition.

78. The method of clause 77, comprising administering one or more doses of the first composition followed by one or more dose of the second composition.

79. The method of clause 78, comprising administering one or more doses of the second composition followed by one or more dose of the first composition.

80. The method of clause 76, comprising concurrent administration of the first composition and the second composition.

81. The method of clause 80, comprising one or more doses of the first composition and the second composition.

82. A composition for editing a gene target comprising:
(i) a base editor fusion protein comprising a programmable DNA binding domain and a deaminase, or a mRNA encoding the same,
(ii) a guide RNA comprising a tracr sequence that serves as a binding scaffold for the base editor fusion protein, and a spacer sequence that corresponds to a protospacer on a ANGPTL3 gene,
wherein the guide RNA directs the base editor fusion protein to effect a nucleobase alteration in the ANGPTL3 gene in vitro,
wherein when the guide RNA and the mRNA is administered at a total amount of at least 0.5 mg/kg, the base alteration occurs in at least 35% of whole liver cells in the mammalian subject as measured by next generation sequencing or Sanger sequencing.

83. The composition of clause 82, wherein when the guide RNA and the mRNA is administered at a total amount of at least 1 mg/kg, the base alteration occurs in at least 40% of whole liver cells in the mammalian subject as measured by next generation sequencing or Sanger sequencing.

84. The composition of clause 82, wherein when the guide RNA and the mRNA is administered at a total amount of at least 1.5 mg/kg, the base alteration occurs in at least 45% of whole liver cells in the mammalian subject as measured by next generation sequencing or Sanger sequencing.

85. The composition of clause 82, wherein when the guide RNA and the mRNA is administered at a total amount of at least 2 mg/kg, the base alteration occurs in at least 50% of whole liver cells in the mammalian subject as measured by next generation sequencing or Sanger sequencing.

86. The composition of clause 82, wherein when the guide RNA and the mRNA is administered at a total amount of at least 2.5 mg/kg, the base alteration occurs in at least 55% of whole liver cells in the mammalian subject as measured by next generation sequencing or Sanger sequencing.

87. The composition of clause 82, wherein when the guide RNA and the mRNA is administered at a total amount of at least 3 mg/kg, the base alteration occurs in at least 60% of whole liver cells in the mammalian subject as measured by next generation sequencing or Sanger sequencing.

88. A composition for editing an ANGPTL3 gene comprising:
(a) a mRNA encoding an adenine base editor protein having an editing window, and
(b) a guide RNA comprising a tracr sequence that serves as a binding scaffold for the base editor protein and a spacer sequence that serves to guide the base editor protein to a protospacer sequence on the ANGPTL3 gene,
wherein the spacer sequence is complimentary, at least in part, to a splice site or an exon region of the ANGPTL3 gene.

89. The composition for editing the ANGPTL3 gene of clause 83, wherein when the base editor protein is operatively bound to the guide RNA and the guide RNA is hybridized with the complementary strand to the protospacer sequence on the ANGPTL3 gene, the editing window encompasses the splice site of the ANGPTL3 gene.

90. The composition for editing the ANGPTL3 gene of clause 88, wherein when the base editor protein is operatively bound to the guide RNA and the guide RNA is hybridized with the complementary strand to the protospacer sequence on the ANGPTL3 gene, the editing window encompasses a region of an intron of the ANGPTL3 gene.

91. The composition for editing the ANGPTL3 gene of clause 88, wherein when the base editor protein is operatively bound to the guide RNA and the guide RNA is hybridized with the complementary strand to the protospacer sequence on the ANGPTL3 gene, the editing window encompasses a region of intron 1, intron 3 or intron 4 of the ANGPTL3 gene.

92. The composition for editing the ANGPTL3 gene of clause 88, wherein when the base editor protein is operatively bound to the guide RNA and the guide RNA is hybridized with the complementary strand to the protospacer sequence on the ANGPTL3 gene, the editing window encompasses a region of intron 1 of the ANGPTL3 gene.

93. The composition for editing the ANGPTL3 gene of clause 88, wherein the spacer sequence has a 80-100% nucleotide sequence identity to a spacer sequence selected from the group of guide RNA sequences identified as GA067, GA100 and GA574.

94. The composition for editing the ANGPTL3 gene of clause 88, wherein the tracr sequence has a 80-100% nucleotide sequence identity to a tracr sequence selected from the group of guide RNA sequences identified as GA067, GA091, GA098, GA099, GA100, GA101, GA102, GA103, GA347, GA441, GA442, GA472, GA473, GA474, GA475, GA476, GA517 and GA547.

95. The composition for editing the ANGPTL3 gene of clause 88, wherein the mRNA has an 80-100%0 sequence identity to the mRNA sequences identified as MA002, MA004, MA040, MA0041, or MA045.

96. The composition for editing the ANGPTL3 gene of clause 88, wherein the mRNA has one or more of the GC nucleotide region percentages set forth in the following table:

| Nucleotide region | Average GC Nucleotide Content |
|---|---|
| 27-213 | 67-73% |
| 389-661 | 67-71% |
| 735-829 | 63-74% |
| 4207-4286 | 67-70% |
| 4537-4569 | 65-73% |
| 4683-4741 | 62-67% |

97. The composition for editing the ANGPTL3 gene of clause 88, wherein the mRNA has one or more of the GC nucleotide region percentages set forth in the following table:

| Nucleotide region | Average GC Nucleotide Content |
|---|---|
| 27-213 | At least 73% |
| 389-661 | At least 71% |
| 735-829 | At least 74% |
| 4207-4286 | At least 70% |
| 4537-4569 | At least 73% |
| 4683-4741 | At least 67% |

98. The composition for editing the ANGPTL3 gene of clause 88, wherein the mRNA and gRNA are encapsulated within a lipid nanoparticle.

99. The composition for editing the ANGPTL3 gene of clause 88, wherein the mRNA and gRNA are encapsulated within a lipid nanoparticle having the following:
LNP composition (mol %):
40-65% iLipid
2-20% DSPC
1-5% PEG
Remaining mol % balance is cholesterol;
LNP Particle size: 55-120 nm Z average hydrodynamic diameter; and
Polydispersity index of <0.2 as determined by dynamic light scattering.

100. The composition for editing the ANGPTL3 gene of clause 88, wherein the mRNA and gRNA are encapsulated within the lipid nanoparticle having an LNP particle size between 50-70 nm Z average hydrodynamic diameter.

101. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 40 percent.

102. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 50 percent.

103. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 30 percent.

104. The composition for editing the ANGPTL3 gene of clause 88, wherein the composition when administered to a group of cynomolgus monkeys via intravenous infusion at a dose of approximately 1 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 40 percent.

105. The composition for editing the ANGPTL3 gene of clause 88, wherein the composition when administered to a group of cynomolgus monkeys via intravenous infusion at a dose of approximately 1 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 50 percent.

106. The composition for editing the ANGPTL3 gene of clause 88, wherein the composition when administered to a group of cynomolgus monkeys via intravenous infusion at a dose of approximately 1 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 60 percent.

107. The composition for editing the ANGPTL3 gene of clause 88, wherein the composition when administered to a group of cynomolgus monkeys via intravenous infusion at a dose of approximately 1 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 70 percent.

108. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 40 percent.

109. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 50 percent.

110. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 60 percent.

111. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 70 percent.

112. The composition for editing the ANGPTL3 gene of clause 88, wherein the composition when at administered to a group of cynomolgus monkeys via intravenous infusion at a dose of approximately 1.5 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 80 percent.

113. The composition for editing the ANGPTL3 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 40 percent.

114. The composition for editing the ANGPTL3 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 50 percent.

115. The composition for editing the ANGPTL3 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 60 percent.

116. The composition for editing the ANGPTL3 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 70 percent.

117. The composition for editing the ANGPTL3 gene of clause 88, wherein the composition when administered to a group of cynomolgus monkeys via intravenous infusion at a dose of approximately 3 mg of the guide RNA and mRNA combined total weight per kg of the cynomolgus monkey weight is capable of inducing adenine base editing at the ANGPTL3 target splice site in the liver of the cynomolgus monkeys with an average editing percentage of greater than 80 percent.

118. The compositions for editing the ANGPTL3 gene of clauses 87-117, wherein the percent editing is determined at 15 days after dosing through analysis of dosed cynomolgus monkey liver either via liver biopsy or necropsy of the monkey.

119. The compositions for editing of the ANGPTL3 gene of clauses 87-117, wherein the percent editing is determined to be durably maintained by periodic liver biopsy testing of the dosed cynomolgus monkeys over a span of at least 168 days after dosing.

120. The compositions for editing of the ANGPTL3 gene of clauses 87-117, wherein the percent editing is determined to be durably maintained by periodic liver biopsy testing of the dosed cynomolgus monkeys over a span of at least 300 days after dosing.

121. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed cynomolgus monkeys on average of at least 35 percent as compared to baseline.

122. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed cynomolgus monkeys on average of at least 40 percent as compared to baseline.

123. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of monkey weight is capable of reducing ANGPTL3 protein in the plasma of the dosed cynomolgus monkeys on average of at least 50 percent as compared to baseline.

124. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed monkeys on average of at least 60 percent as compared to baseline.

125. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed cynomolgus monkeys on average of at least 70 percent as compared to baseline.

126. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing ANGPTL3 protein in the plasma of the dosed cynomolgus monkeys on average of at least 80 percent as compared to baseline.

127. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 35 percent as compared to baseline.

128. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 40 percent as compared to baseline.

129. The composition for editing the ANGPTL3 gene of clause 88, wherein the composition when administered to a group of cynomolgus monkeys via intravenous infusion at a dose of approximately 1 mg of the guide RNA and mRNA combined total weight per kg of monkey weight is capable of reducing ANGPTL3 protein in the plasma of the dosed cynomolgus monkeys on average of at least 50 percent as compared to baseline.

130. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 60 percent as compared to baseline.

131. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 70 percent as compared to baseline.

132. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing ANGPTL3 protein in the plasma of the dosed cynomolgus monkeys on average of at least 80 percent as compared to baseline.

133. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 35 percent as compared to baseline.

134. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 40 percent as compared to baseline.

135. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 50 percent as compared to baseline.

136. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 60 percent as compared to baseline.

137. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 70 percent as compared to baseline.

138. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing ANGPTL3 protein in the plasma of the dosed cynomolgus monkeys on average of at least 80 percent as compared to baseline.

139. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 35 percent as compared to baseline.

140. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 40 percent as compared to baseline.

141. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 50 percent as compared to baseline.

142. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 60 percent as compared to baseline.

143. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 70 percent as compared to baseline.

144. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing ANGPTL3 protein in the plasma of the dosed cynomolgus monkeys on average of at least 80 percent as compared to baseline.

145. The compositions for editing of the ANGPTL3 gene of clauses 121-144, wherein the reduction in plasma protein is determined at 15 days after dosing via blood sampling and analysis of the dosed cynomolgus monkey.

146. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of monkey weight is capable of reducing triglyceride level in the plasma of the dosed monkeys on average of at least 20 percent as compared to baseline.

147. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 25 percent as compared to baseline.

148. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 30 percent as compared to baseline.

149. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 35 percent as compared to baseline.

150. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 40 percent as compared to baseline.

151. The composition for editing the ANGPTL3 gene of clause 88, wherein the composition when administered to a group of cynomolgus monkeys via intravenous infusion at a dose of approximately 0.5 mg of the guide RNA and mRNA combined total weight per kg of cynomolgus monkey weight is capable of reducing triglyceride level in the plasma of the dosed cynomolgus monkeys on average of at least 45 percent as compared to baseline.

152. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 20 percent as compared to baseline.

153. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 25 percent as compared to baseline.

154. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 30 percent as compared to baseline.

155. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 35 percent as compared to baseline.

156. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 40 percent as compared to baseline.

157. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 45 percent as compared to baseline.

158. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 50 percent as compared to baseline.

159. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 55 percent as compared to baseline.

160. The composition for editing the ANGPTL3 gene of clause 88, wherein the composition when administered to a group of cynomolgus monkeys via intravenous infusion at a dose of approximately 1 mg of the guide RNA and mRNA combined total weight per kg of cynomolgus monkey weight is capable of reducing triglyceride level in the plasma of the dosed cynomolgus monkeys on average of at least 60 percent as compared to baseline.

161. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 20 percent as compared to baseline.

162. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 25 percent as compared to baseline.

163. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 30 percent as compared to baseline.

164. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 35 percent as compared to baseline.

165. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 40 percent as compared to baseline.

166. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 45 percent as compared to baseline.

167. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 50 percent as compared to baseline.

168. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 55 percent as compared to baseline.

169. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 60 percent as compared to baseline.

170. The composition for editing the ANGPTL3 gene of clause 88, wherein the composition when administered to a group of cynomolgus monkeys via intravenous infusion at a dose of approximately 1.5 mg of the guide RNA and mRNA combined total weight per kg of cynomolgus monkey weight is capable of reducing triglyceride level in the plasma of the dosed cynomolgus monkeys on average of at least 65 percent as compared to baseline.

171. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 20 percent as compared to baseline.

172. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 25 percent as compared to baseline.

173. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 30 percent as compared to baseline.

174. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 35 percent as compared to baseline.

175. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 40 percent as compared to baseline.

176. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 45 percent as compared to baseline.

177. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 50 percent as compared to baseline.

178. The composition for editing the ANGPTL3 gene of clause 88, wherein the composition when administered to a group of cynomolgus monkeys via intravenous infusion at a 178. (continued) dose of approximately 3 mg of the guide RNA and mRNA combined total weight per kg of cynomolgus monkey weight is capable of reducing triglyceride level in the plasma of the dosed cynomolgus monkeys on average of at least 55 percent as compared to baseline.

179. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 60 percent as compared to baseline.

180. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing triglyceride level in the plasma of the dosed cynomolgus monkeys on average of at least 65 percent as compared to baseline.

181. The compositions for editing the ANGPTL3 gene of clauses 148-182, wherein the reduction in triglyceride level is determined at 15 days after dosing via blood sampling and analysis of the dosed cynomolgus monkey.

182. The compositions for editing the ANGPTL3 gene of clauses 148-182, wherein the reduction in triglyceride level is determined to be durably maintained over a span of at least 168 days by periodic blood sampling and analysis of the dosed cynomolgus monkey.

183. The compositions for editing the ANGPTL3 gene of clauses 148-182, wherein the reduction in triglyceride level is determined to be durably maintained over a span of at least 300 days by periodic blood sampling and analysis of the dosed cynomolgus monkey.

184. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) in the plasma of the dosed cynomolgus monkeys on average of at least 10 percent as compared to baseline.

185. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 15 percent as compared to baseline.

186. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 20 percent as compared to baseline.

187. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 25 percent as compared to baseline.

188. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of at least 30 percent as compared to baseline.

189. The composition for editing the ANGPTL3 gene of clause 88, wherein the composition when administered to a group of cynomolgus monkeys via intravenous infusion at a dose of approximately 3 mg of the guide RNA and mRNA combined total weight per kg of cynomolgus monkey weight is capable of reducing lipoprotein(a) level in the plasma of the dosed cynomolgus monkeys on average of approximately 35 percent as compared to baseline.

190. The compositions for editing the ANGPTL3 gene of clauses 186-191, wherein the reduction in lipoprotein(a) is determined at 15 days after dosing via blood sampling and analysis of the dosed cynomolgus monkey.

191. The compositions for editing the ANGPTL3 gene of clauses 186-191, wherein the reduction in lipoprotein(a) is determined to be durably maintained over a span of at least 224 days by periodic blood sampling and analysis of the dosed cynomolgus monkey.

192. The compositions for editing the ANGPTL3 gene of clauses 186-191, wherein the reduction in lipoprotein(a) is determined to be durably maintained over a span of at least 300 days by periodic blood sampling and analysis of the dosed cynomolgus monkey.

193. The compositions for editing the ANGPTL3 gene of clauses 101-194, wherein to the extent that the dosing of the cynomolgus monkeys results in elevation of AST, ALT, or Cytokines, the elevations resulting from the dosing of the composition are transient and resolved back to approximately baseline levels within 3-15 days after dosing.

194. The composition for editing the ANGPTL3 gene of clauses 101-103, 121-126, 148-153, wherein the percent editing of ANGPTL3 is negligible outside of the liver, spleen and adrenal glands tissues as illustrated in FIG. 27.

195. The compositions for editing the ANGPTL3 gene of clauses 101-107, 121-132, 148-162, wherein repeat dosing results is additive with respect to the editing percentage of ANGPTL3 editing percentage.

196. The compositions for editing the ANGPTL3 gene of clause 195, wherein the repeat dosing does not elicit cytokine activation nor an immune response.

197. The composition for editing the ANGPTL3 gene of clause 88, wherein the spacer sequence has at least 80% nucleotide correlation with the nucleotide sequence of a targeted protospacer on the ANGPTL3 gene, wherein an RNA nucleotide on the spacer sequence is in correlation with a DNA nucleotide of the protospacer if it has the same nucleotide as the DNA nucleotide in the same order and wherein uracil and thymine bases are considered the same nucleotide for purposes of determining correlation.

198. The composition for editing the ANGPTL3 gene of clause 197, wherein the spacer sequence has at least 85% nucleotide correlation with the nucleotide sequence of a targeted protospacer on the ANGPTL3 gene.

199. The composition for editing the ANGPTL3 gene of clause 197, wherein the spacer sequence has at least 90% nucleotide correlation with the nucleotide sequence of a targeted protospacer on the ANGPTL3 gene.

200. The composition for editing the ANGPTL3 gene of clause 197, wherein the spacer sequence has at least 95% nucleotide correlation with the nucleotide sequence of a targeted protospacer on the ANGPTL3 gene.

201. The composition for editing the ANGPTL3 gene of clause 197, wherein the spacer sequence has at least 99% nucleotide correlation with the nucleotide sequence of a targeted protospacer on the ANGPTL3 gene.

202. The composition for editing the ANGPTL3 gene of clause 197, wherein the spacer sequence has at least 100% nucleotide correlation with the nucleotide sequence of a targeted protospacer on the ANGPTL3 gene.

203. A method for treating or preventing an atherosclerotic cardiovascular disease in a subject in need thereof, the method comprising administering to the subject a therapeutically effective amount of
- (a) a mRNA encoding an adenine base editor protein having an editing window,
- (b) a first guide RNA comprising a tracr sequence that serves as a binding scaffold for the base editor protein and a spacer sequence that serves to guide the base editor protein to a protospacer sequence on a PCSK9 gene, wherein the spacer sequence is complimentary, at least in part, to a splice site or an exon region of the PCSK9 gene; and
- (c) a second guide RNA comprising a tracr sequence that serves as a binding scaffold for the base editor protein and a spacer sequence that serves to guide the base editor protein to a protospacer sequence on a ANGPTL3 gene, wherein the spacer sequence is complimentary, at least in part, to a splice site or an exon region of the ANGPTL3 gene.

204. The method of clause 203, further comprising a first LNP enclosing (a).

205. The method of clause 204, wherein the first LNP encloses (b) and (c).

206. The method of clause 204, wherein the first LNP was administered repeatedly.

207. The method of clause 204, wherein the first LNP was administered repeatedly at an interval of one to sixty days.

208. The method of clause 204, wherein the first LNP was administered repeatedly at an interval of seven days.

209. The method of clause 204, wherein the first LNP further encloses (b).

210. The method of clause 209, further comprising a second LNP enclosing (a) and (c).

211. The method of clause 210, wherein the first LNP and the second LNP are administered sequentially.

212. The method of clause 211, wherein the first LNP and the second LNP are administered sequentially at an interval of one day to 12 months.

213. The method of clause 212, wherein the interval is one day.

214. The method of clause 212, wherein the interval is five days.

215. The method of clause 212, wherein the interval is ten days.

216. The method of clause 212, wherein the interval is fifteen days.

217. The method of clause 212, wherein the interval is twenty days.

218. The method of clause 212, wherein the interval is twenty-five days.

219. The method of clause 212, wherein the interval is one month.

220. The method of clause 212, wherein the interval is two months.

221. The method of clause 212, wherein the interval is three months.

222. The method of clause 212, wherein the interval is five months.

223. The method of clause 212, wherein the interval is eight months.

224. The method of clause 212, wherein the interval is ten months.

225. The method of clause 212, wherein the interval is twelve months.

It will also be appreciated from reviewing the present disclosure, that it is contemplated that the one or more aspects or features presented in one of or a group of related clauses may also be included in other clauses or in combination with the one or more aspects or features in other clauses.

LENGTHY TABLES

The patent contains a lengthy table section. A copy of the table is available in electronic form from the USPTO web site (https://seqdata.uspto.gov/?pageRequest=docDetail&DocID=US12115230B2). An electronic copy of the table will also be available from the USPTO upon request and payment of the fee set forth in 37 CFR 1.19(b)(3).

SEQUENCE LISTING (2230 sequences)

SEQ ID NO: 1 - protein, 167 aa, Escherichia coli
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 2 - skipped

SEQ ID NO: 3 - protein, 1566 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 4 - DNA, 4764 bp, Artificial Sequence
  Description of Artificial Sequence: Synthetic polynucleotide
atgagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcaccatcctgggatgaaccaccgggtcgagatcacagagggaattctggctgacgagtgcgctgccctgctgtgcaggttctttagaatgcctagaagggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtg

SEQ ID NO: 5 - DNA, 25378 bp, Homo sapiens
gtccgatggggctctggtggcgtgatctgcgcgccccaggcgtcaagcacccacaccctagaaggtttccgcagcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggtgcgggtgtagggatgggaggccggggcgaacccgcagccgggacggtgcggtgctgtttcctctcgggcctcagtttccccccatgtaagagaggaagtggagtgcaggtcgccgagggctcttcgcttggcacgatcttggggactgcaggcaaggcggcgggggaggacgggtagtggggagcacggtggagagcggggacggccggctctttggggacttgctggggcgtgcggctgcgctattcagtgggaaggttcgcggggttgggagacccggaggccgaggaagggcgagcagagcactgccaggatatcctgcccagatttcccagtttctgcctcgccgcggcacaggtgggtgaaggagtgaatgcctggaacgtactgggaactgcaccaggcacagagaaagcgggcttgccattatagtgggttccgatttggtttggaaaacatgggcagcggagggtggagggcctggagagaaggccctacccgagacaggggcggggtgggaaggacggcagatgctgggagcacgaggcaatttctttatgacacagaactcatgctctagtattccatctgtttcagccgaagaaaagaaccagctgaaggggcaggggagaaggggcggaggtattctcgaggcccattggcgtcctttaggactcaggcagggaagggcccttggtgctctggagccggaggtggtgcgcctggtactgggaccccggagctgagcccggcgcctcagcccacctggctgtctgccgaccgtgtgcggggcgagtttgctcaacaactctgccagcttctggccctcaggctgtgggaagcttcttcccggggcgagaccactagctttttctaagtattaccagcccaggacttggctgaggttctgtgtcccccagcttggagtcagatgtggggttgaatcttggcttcctctcactagctgtggtgcttgacaagtcacttatccttgagcctccattgcctaatctttaaaagggaggtgacaatcgtccctacggctcagtggcagcagatggggagatgaagggaaagttctgttgaccatgagtgaacttacaatgcaagccccggggggatcacttgcagttttgtccctgtctgcagtgtgacctgttggtgacattgtctttgctccaaaccacagctcctggggcagaggggaaaattctgccactcacagctgcctgcccacgcttctgtctgagtgtgctgggtggcaggatggcaagtccttactcagctcagtatagccctcttccttgttccctgagcctttgactttctcgagggatgttgtggggttgtggccaggataagaaagggcatttcaagttaccactgctccaaaacaactgttctggaaatagtgagtaccccatcctgagaggtgagtaagcagaggctgtatgaccacctgaaccaagcccttgaggatgtttcttctctggtggaagtttggaacaggagcctcctcaagttcatttattcattcattcaatggttattttgtgggaatcgaatttagaatgaaaatattttttggcaagcagaaaataatttttagaccaatccttttcttttagtcatgagaaactgaggcccagagagaggaggtcaccccaggtgcattagaactgggtttccagaactgacactccactgcacagagtactctcccaattcattcaatttttatttagcggaaggcattttcagatgggtctttgaagcattagtaggagttcagcgatgatggtgtcatgagaattttattctaggattaggaggtaccatgaacaaagatacagagctgggaaaaccagaggtggaagataaggagcacatgtccacagttctttttcttttttttttgagatggagtttcgctcttgttgcccaggctggagtgcaatggtgcagtctcagctcactgcaacatctgtctcccgggttcaagtggttctcctgcctcagcctcccaagaagctgggattacaggtacctgccaccacgcccggctaatttttgtatttttagtagagaaggggtttcaccacgttggccaggctagtcgcaaactcctgacctcctcagtggatccgaggaggtgatcctcccgcctcagcctcccaaagtgctcgaattacaggtgtgagccaccacgcctggcctccacagttctttatccaccgtctgaaatgtaaaatgttacgaaaaccaaaagttttttttgtgatttatttgatggtagcacctgacgtgaactgacatgagattatttttaatttagttgtgtgaatatgcatattcatatattttgctgcatagattacagtatgcagctccagattcttccaagcagactctgattgcccattactgcctttctaaaatccaaacaagttctgaggttcaaaaccgttttggccctaaggctttgggtaaagggggtggactctgttctactctgactggagtccaagatgcatatatacagagatatgggtgatggggctgcaaggtaggttgaggtaggggccaaggaggagcatggagtttggacttgattcatgaggctgtggggagccagtgaaggttcttaagcaggtatgtctgcctgagagcagttggagcagacaagagctaaaaaccaaacaaatcaccatagatagtggctgctataatttgtttgtcccctccaaatctcatgtggaaatttggtcctcagtgttggaagtggggcctaatgggaggtgtttgggtcatgggggaggaacccctgtgaaaggcttggtgccgtccttgtgataatgagtaagttctcccgctatgatttcccttgaaggctgattattaaaaagagcttggcacctccctctcttctctcttgcttcttctcttgccatgtgattgatctctgcacatgtaggctccccttcaccttctgccatcagtgaaagcagcttaaggccctcaccagaagcagatgctggtgccatgcttcctggagagcttgcagaatcatgagctgaataaatcccttttccttgtaaattactcaccttcaggtattcctttatatagcaacacaaaaggactaagacagtggccttgacttttctctctctttaagaagtgttgcctttgctcacttagtcatcccttctgcctgcatttgtagagcatctggatgggagatttatataaccgtcactcttgactttcccagcaggcctatgtcataggtactgtggtctctacaatacagcagaggtatctgaggctccgagaggttgagtgacttgctcatggctgcacaaccagtaaatattggagctggaattcaggtccacggtttcctggctccaaagcccatgattttttccctcaatttattctgactggggcatgggggagggggtggcctttgggcagggccaccaggagcgaccaggcccgtagagagctgggtgcaggtacagaggaaaacctgttgtcgagtgtggcccgtagttcccatttttgcctgaatggcacatttgaaagtgttatataaccatgtgaataataatagttggcctatatgagttctttaatttgctttttggtccgcatttggtaacttctttatcatctactatactctgttgtgtctcttttgttgtaatttgtaagtaggggtgagataaagtacacctagggtttgctgggtttcttccatgtcatcatgttcctccttgcatggggccaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggtgagccaccctttttgggaatggcacttcctgatagggctgggccactgcatatacactggggactgtgcttagtaggcccattgctgaaaatcagaaggggacagcaagtatgtattgagcacttatcgggtaccaagcacagtaactactggctttctgtatagaattccctttaagcctggccatgccccagtggtacgtctatcttcatttgaaagacgaggagactgaagttcagaggggaccacacagacagctaggggtagagcctggatcaaacccattggtctgcctgccagccattcttgtgccaatgcatctgctgcctacggaaacctgtagggacaaggccctgggatgttcagtggagcctgagtcattttataaaaaagcatgactctagggtccaaaattcctttgaagctgttgctatccagagtgaagtcccttctttaggacagggtggccctcctccctcctggatgtcacatcttcggtggaggggcagaaaggggactgggtattctcctcaccctggccctagtgcttcaaatcttaaaaaaacgtttttatttgtgcttctgcaccaccttctagcccacctcgtttcctggcctctaacttgatgagagcgtgtgtcattttcacactgattctccacatggcaggcggtgcttcttagcctcctgcagacagtgaggccccacggtcttgtccaaggtcacacagcgtgtaatgggcagggtcagagtctggagtctggacctgggtctcctagctgcactgcactgctgccccatgggttaatcagctcagcataccgtggctgaacagctacctcataccaaggcctgtggcgccatgacagggattgacagggtccctgccttggaaacccgtagtctaagtagaggagactgacaagtcaatgccttccatcagtctgctcaacacacgtttaccaagtgcctactgtgtgctgcagaggcgaagatgacacagctcaggcctttcccttgagcttacagttcaggaggagagactgaccagtgactgccagtacagttgactatgggacaatgtgctcagccttggggagagacgaagaaggtacccgtatagcaccagatgacaggcacgagccccacaggccagggcagctgctcagaggagagtaggccaagcagaaggcaaacagaaggctgcaggcatttgccatcgagagctggacttcaaactgggcatcataccagcctgggttcgagtcctgcccagccccttattggctgtctaaccctgagcaaatcccttcacctctctgagcctcattcctctatctgtaaaccagttataataattggaacattcatttaaggactaaatgaggtcgtgaagcattcagcagatgctaggtacggaaactcgctgaagtgggggcaggttaagaagcctctggggatacgaaggcatccagggactagttgtggcaggaggctgttaccacttaggtctgaagggtaaggagagggaatagctttccctctgcccagttggagccggtggcatggaggagaggctgcctgtggggaatcacccgagggttcaccgctgccatgcgcagggagtcaggaggtagggagggagtggggcagatgcacaccatttttttttttttttgagactctgttgcccagactggagtgcagtggtgccatatctgcacctctgcctcccgggttcaagctcactgcaacctctgcctcccgggttcaagcgattctcctgcctcagcctcccgagtagctgggactacaggtgtgtgccaccatgcctggctaatttttgtatttttaatagagatggggtttcaccatgttggccaggctggtctcgaactctcgacctcaggtgatcccccacctcggcctcccaaagtgctgggattacaggcgtgagtcaccgctcccagctgctgatgcactcttgtccttctaactcctgctagtgcctcccattggctgagcccaactggaagctttgcaagggagctggtgctgcagtttgcactgagcaggctggagaaggctggagaatagactaggggacaaaccgaattgccagtgctgttatgtcatgatttaggcatggagtccagggcctgagcttcactccatgtccatcctgcccagagccttggcacagcctggctcccagacaagatgtcaagttcagaatccttcctaaaaggaatcctctatgccagaccgtgttgcagggatatgggagtgctgggctcccagcctgatcaaggagcgagaaaactcaggctcctagtctgtcctccggggcactagcagggacaaggtgggaggctgctgggctgggatgtggggacaggtttgatcaggtaaggccaggctgtggctgtgtttgctgctgtccaaatggcttaagcagagtcccccggcctctctggcttctgcaggccttgaagttgccccatgtcgactacatcgaggaggactcctctgtctttgcccagagcatcccgtggaacctggagcggattacccctccacggtaccgggcggatgaataccagccccccggtaagacccccatctgtgccctgccccaccccatctgagctgaatccatttgctctgccctggcctggcctccctgctggtggtttccacttctcggggggctttgggactcagcacctccactgacccctttttttctgtcccatccccatcccctgcagcccccactgcctgccttcctgttgccccacaaatgcaaaagtcttgccttaaatgatcctcttttccttcttttctcttgttttccttttctcaccatttggaatggcccagcaggctgcacttaccttggaaggagggttcatctgatggtgactctacctagggcccccaggcctctataactcccagtgccctgcagactggaccagatcctttaatgggatagacacaaccctgtctgggatgcctctgcctaccttcctgttttgctgctccacctgcctccagctccgtttggcttcctggggctccctgcctgggccactttgtgtcttccctctaggcctttctttccactgttccctctgcctggtgtggcctggctatggaagggagggaggaggagcggccatggaaaacggtctgcattctagcagggacttgcaggtggcaattcagtcggggaagactctagatgcacctggcctgaggagagaatgaagggttctagttggactgtgttaagtttgaggtgcccatggtgtgaggtctggagctcagcgcagagatgatgcaatgtggtgggtccatgcaacatggtgccaggacgcagagcttggggtgaactcagctttcaccccttaccggttctcgtgggatcttgggaagccactttcttctatgagctttgtcgttcttgtctgtaaaatgggcacataaccctgtccctgtccttctcacaggttgctgtgagactccaatgagttgaaggatgtgcagatgcttttggaagtgaaaagttggggggctactgtgtgactttgcatacacccaaactgtgtgaccttgcatatgtctgagttgctgccattgcaacagatcagagctggtgggctgggtgtggagaaagggtttgtgtgggggacatcctctggcaagggtggcagcagcagaagtgaggggcctggtcggtcatgtgtgctgacccggcctgggcagcctgtggccagggagaggacagctcctctgtaggaagagcctgttcctttccaaccaggtgagacctcttcagtggagccctggagccccctgtactccacatcagtgcctcagggacctcccggagcaggctaatatcagagaccaagagggacactggcagaggatcacagagaccccagtccaggcagggactgagaagatcttgccccctaagttagtttcctagcactgctgtgacaaattaccaccccctcggttggaacaagttgattctctgcagtcctggaggccagaagcctgaatcagtgtcggcaggaccactttctcccggggggctccagggagaagcttctcttgcctcttccgtgtcccaacagcggcagcacaccaatcccagcctctgtcttcacacagccttctctgtgtctctctcctcttcattgtctcataaggacacttgtcattggatttagggcccactggatcctccaggatgatctcatgtggggaaccttaaccacatctgcaaggaccctttttccaaataaggtcacagccacaggttgtgggggttaggatgtgagtgtatctctttggcagccactgttccctcctctcccttgggccagaagcagacgtggggccctttcttccccataggatgcccatggattgccccccttcccgcttcccccgagtgtctgtgggaggtggcaggaatggcaggcaggggtgtggaaccccttctggagtcatatcaagggcttggctggaggaagtcctcctggagctgttgggctggcatggggcaggctggctgggcccagcagcagcttcttcattcatggggaggccacaagcatgggccctagagctggctgccgccctcaaacccagaccctgcactcttaactgtgtgaccttgcatacgtcactcaccctctctgatcttcaggttcctctgcaaaagggaggtaatgataaccctcactctggggggctgtttggagggttaaatcagttattgctgtagcatgcatttctctgtcaggtattgagtgaggtgctgtgattttagccctgcatttttcttttcttaccattcaataataacgttttgagcacccactgtgcgccaggcaccatattaggtgctggggatacaaatgtgaatgaaatgaatgtggtctcttcccccaacagtgtatccagaagattaatccattccttaaacaaatgctacttgacacagattagttctggataggctgagagctctgaaggagtgcaggcagctgcgagcctgtgtatccagcagaaggatcaggaaaggattcctggaggaagcgctgttctagccaagacctacgggggcattattaaccaggcaaaggggacggtgtccaagcagtggaatgaacgtggattgaagctgtgaggcaggagggagtgtggcctgtgcagaagggaccgaggctggtgagaccaggagggcctgggtggcctccaggtcagatgtgaaaggaagaacttggccacagtctgagcttctcaggcgtatggcagggctgcctggtgagagggaatgagctccctgctctggaggtatgcaagcaggactgggctctcacctgccagaggccacagagctttccagaggctggaagaggccactccaaggcctctttgcccctgagagtggtggctcttcttgaggccaccttgccacgctgtcacagggaactagcagcccctgcctcacccgggggtttggaagatagagggaggcctaggaagggccctgtgtctcatccgagctgggcccctttccagcctctcactggaaggaagcccaaggatgttcctgtgggggcttttaccaggcccacctgccctctgctggccatgcttgcagcctcctgaccctgtcccagcaggacagtgggctggtgtgagcgggcaggaaccgcctgcacttagaaggtgtggggctgcctccccgagcttccatctgccgctggggccacaccccaggcccagggatgggaccccacagtggtcacatcatcttgcagcagaacccaggtacagctcctggagcagatggtggtcccaagcacgggtgggaccagaaaggactctcacctgggctaactcagctgcagcctcagttccctcctcacacacgacgaggaacatggactggaagcctgcccagcaggccttctgctcgatgtgcgttgtgtggcttacgtccagggagggaagcagcctctgtgctgtcttctagataagcctgtattccccgggctgtctgccaatgtatccagttgtcccgtcagcctggaagctctgagggaaaaccttgggctgcttcctgagcacctgtatcccctgcagccagcccggggcctctgctaggagcagactgagcatggcttatgggcctggcaccatctggcctctgcccaccttgctggccttgtcttgtgtctgccccttcgacattccatagcccagctcaatatctagtggttcctctagggtggcgagcactgtttggtctccagatgtcttcaggtcggagctcacagcgctctcagccaccccttcccagtgtagcaccgggcacatggtagatgcctattgatgagtgaaagctcctaacacactcagagagcaaggactccgcctcatcccacagcctgggaggagaggcagactgccaaggacctgctcagcatgctacagaagaaaccaaagtgcccacgggactgatcagtggagcttcctgccgagactggaggccttagggcagggtagacagtgtgtgtgcaggctggggactcacagttcggactgtgcccagacctactagcatagtgggtgggtgggaggatgcgggactgggggccgaccttgcctgaaattcatgtgggatctcagagcagccactgaattgctctgtagggggctaaatagtggcccccacagatacacacacccagacagagcctgtgagccagaccttatttggagaaaaggtctttgtagatgtaattaagcatctcaagatggcatcatctggattatgcggtgggctgtaagtcctgtgatgtgtctttatgagagaaaggcagagggagatttgacacacacaggaggggccacgtggagacagaggtggagattggagaaatgtggccacaagccagggaacaccagcagccaccagaagccggaagacgtgaggcagggttcttcccagagccttcgctgctgagtctgggaatttgtgaccgaagccataagaagtgggtacacgccctgagcctcccacacttgctcacctgtcctgagatgagaatctctactctgcagcatatttggaggatcactgcgggggccacagaggtgctgttcagatggcacttcagaagactcaggagaccctggggcaggagcagtttgactgacagcccagagggctgccctctgattccacctgaggccctgcttttcctggctgcaggggttccagggccaggccatttccgctggcgcaggactctgctagcagcaacctgcctgaagtcttcctttggcctggctgagagtttctgagacctgcgctggagcggaggtgcttccttccttgcttcctttcttcctctctcccttctccatccagcaggctggacctgcctggcatctgtgagctctccctactttctcctataccctaacctttgtcctgcatgggcgactcccccagtgagtctcttgcagcttttaccccagtgcctgcttcttggagaatccaaactgatccagttagggatgataaagtgtagggtaggcgctcggtgactgttttctctgaggttgtgactcgtgtgaggcagaagcagtccccgtgagccctcctggtatcttgtggagtggagaacgcttggacctggagccaggaggcccagacatacatcctgtccgagctgcagcttcctgtctctaaaatgagccggccagcgcaggtggccagacatcactgttattctcctttgagtctttaaatcttgttgtctttcttgcagactcggtgagctgtgaaaggctataataggggctttattttacactttgatactattttttgaacattcatattattgttagatattgatattcatatgaaggagcaggatgacttgggtccttcttggcagtagcattgccagctgatggccttggacagttacctgccctctctaggcctccctttccttgtctatgaaatacattatagaataggatgtagtgtgtgaggattttttggaggttaaacgagtgaatatatttaaggcgctttcaccagtgcctgggatgtgctctgtagtttctgtgtgttaactataaggttgactttatgctcattccctcctctcccacaaatgtcgccttggaaagacggaggcagcctggtggaggtgtatctcctagacaccagcatacagagtgaccaccgggaaatcgagggcagggtcatggtcaccgacttcgagaatgtgcccgaggaggacgggacccgcttccacagacaggtaagcacggccgtctgatgggagggctgcctctgcccatatccccatcctggaggtgggtggggactgccaccccagagcgttgcagctgtactcctgggttgcaccccccccagctgtcactgtcccctccctgccatcagttgtgggaagggcgttcatccatccagccacctgctgatttgttatagggtggagggggggtctttctcatgtggtccttgtgttcgtcgagcaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggtaagtgatggccccagacgctggtctctctccatctggacctggcctgggaggtggcttgggctgggcccagggagagctaatgtctcctaaccaagaatgctgtggcagcctctgccgcagagccagagaaccagagtgccaaggctggcagggttcccagtggccacgagtgcagatgaagaaacccaggccccaagagggtcatgcaggtagcccagggagttcagccttgaccctgggtcaatgacctttccacagttccacactgctccccttttaaaatccggtgatgtctttatgtcttttgttatgttatcttcaatgtggagggactcgaggtgatctaagcaaactttttctatcttctgcttgcatacctctgagaccaggggactcactcacttgcatgactgggccctgcaggtcacactggccaggcagatgtggtggaggaactggcagaggactttttctagactgtgactacatttagtccacccagcggcccccctatgaagtccagttgagaactaggactctgggggccggtggacagagaagagggagggttctctcccttactgacttccttctgtggccagacattgagcaaggcctctgtacagcatgtcctggggctggccttgccgtagctgctaaatagttgacgaaaccagtccagagaggggaggtgactgccagggtcgcacagctcaagctggggaactcgctgggaaaactgtcagctctgggcagcagcttgacttccactgtaagccccagcccccagggtcaaacactggctctggtgctggcagaggcagcccactagcctgtttcaaaggctgagaaggcccaggagtctgccctgtgctccaccagttctgccctgagactttcctacagagtacaggttttgatgttcagttttaaaggcaagaatcaataaccttctgccccatcaggtgaccccttgtgcctgtcccacccctttattgactgacctcggctcagtcaggtcagttcctgaaggtcagtgtgtggaggggaggctgttctttcccagaaaggccttccccaggcctggtgctctggcctctggaggacttcctggagaagtcccttctttggggtcccagtcagtgtatgggaagcccttattgcatgacctggcacggggcaggggctcaacagtcactattgccttccttgccactgccatttcctcctctgtaagcaggtgattgtgtgtccagtctgagcacagagataagcacacagcaggtgcttaataactagcagctgtaggctgggcgcggtggctcatgcctgtaatcccagcactttgggaggccgaggtgggcagatcacctgaggtcaggagttcgagaccagcctgttcaacatggtgaaaccccgtctctactaaaaatacaaaaattagccaggcatggtggtgggtgtctgtatcccagctacttgggaggctaaggcaggagaatcgcttgaacccaggaggtggaggttgcagtgagctgagatcgtgccactgcaatccagcctgagtgatagagcgagattccatctcaaaaataaataagtaaataactagcagctgtaaatgtggctgttgttcttcacctccacactcagtgccactccactccctccctccgtggtgtgaggggcctcactagctgtctcctaggaggagcatggctgtgagattccagctccatccttggccacggctcctggagacatcttagaggccaggatccagaaggctcccacacctcatttgacaggggagaagctgtcagttccaggtccccttgcacatcagggccagagctgcgttaggcctccagtctccaggccactgggccagagctcacaggctggcagagggttagaactgttactggtggctgggtgcagtggctcacgcctgtaatcttagcactttgggagggcaaggcgggaggatcatgaggtcaggacatcgagaccatccttgctaacacggtgaagccccgtctctactaaaactacaaaaaattagccgggcgtggtggcaggcgcctgtagtcccagctactcaggaggctgaggcaggagaatggcgtgaacccgggaggcggagcttgcagtgagccgagattgcgccactgcactccagcctgggcaatagagcgagactccgtctggaaagaaaaaaaaaaaaaagagctgttactgttgacagtagcatgaggtagaccatggcctgcaccaaaatgggggagtggagtgccactgaggccagaaggaaccacaccctcaagggtggggagttatggtatggggggtcctaggcatggagtcttttaattctttagacaatcctgggagcaactgtccctgtttcacagagggcggggccacacagctggtgagtgggcagccaagactctgttcaagtttgtgtgggtccaacacttgcggccacggtggaggggcatctgagccaggcctcagagagtggcgggggaagttgggtggggaagtgtgcccttctcattcctctgaggctcatcctcttggtgcctctctttcatggaaagggataataaggttattgtgaggatcccctgagttcgtatattcagacgcttagacagagccaggcacagagaagggcccggggttggctagtttgattgctggtgtaattgctaatatcttccagtttgtattggtcaaggttctgcagagaagcagaaccagtaggatgtatatattaagagtttcaagctcatgtgaccgtgcgggctggcaagtctgaaatccgcagggcaggccaggcaggctggcaattcctgcagaatttgatgttgcaatactgagtcctaaggcagtcctggggcagaattccttcttccctgggaggcctcagtctgttctcttaaggccttcaactgattaaatgaggcctgcccaagttatagagagtaacctgccttactccgtcttctgatttaaatgttagtcacatctaaaaaatattttcgcagcagcatttccactggcttttgaccaaacatcaggccacaaagttgatccccaaaattaaccatcactctgtgcctgtaagggaggggctgggaaaggggagcaggtctccccaaggggtgaccttggctttgttcctcccaggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtaggtgctggggctgctgccccaaggcgcgggtagggggcggagggcggagggcggagggagggcgggcgggcaggcgggcttcttgtggcacgtgggcttcttgtggcacgttcctggaggccgaacccttctggctttggaaggagtcgtcagagacccccgccatgcgggaggctggggaggaaggggctcgaaacctccatcatcgcagagtctgaatagcagtggccccgccatgcgcccacgtagcggcgcctacgtagccacgcccccacaccccgtcctggccactctccctcctgaaggtcttctggtacccgccccctccccatctccatccccaggccctgcgtcctctgcccaatactctttgggcctccctgttgtccagctctctccgcggctccatgactgacaacttgagcaaggctaatgtgaatgggagcggttgagggctcagacctctcacccgaggaacatccacagagtgtgccgcatgcccggtgcagtgtggctgcggggacacagacacggagcctcggccctgaggagctggggggcagtgaccgtccctcctctgacccaccactcctccagtgtcaggacactgcgggtatctaggggaaggaatcttgttccacttcaagtctggaacttcaagtctgtgtgtgtgcgtgcgcgcgcgcgcgttgggggtgggggttgcagagcagatgcgtacctgacagcggtaacctaggtcccccctggcctatcaaggcttccctggcggccgaatttaaaggcatcaagcaaacaaagcccaacacatctctgccttgtcctctcagtttccccccgtggcacttagaaccacttgatacaccgaatagtttcctatctcccccactaggatgtaaactccacaggggcattgggaatgctgcctggctatggtagggacagaggggagcaccagggcggggcaggggtgccagagttctgcctgggcagtcagattttccttaggaggggacatttgagtgggacccaaacaggtgtatagcagttgtccagcccagctggcaaggcctgagtctgcctctgcaacccctctcttgggctcctttctctgccacccacctcctcacctttccaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggtaagtcaccaccccactgcctcggccaccgtgatgctaacagcccctttggcagtcagggtctgtgccgggacctccagtgccaggctctgtgcagggggaccagagatgaagtaggcctgatggtgccttcaaggacactcagtctgatgagggaggcgagtgcacagaggaaacacgaggtcagggctgtattagagggagcccagaggaggcacctgcccagcccgagggtcagagaaggcatcttggaggagggacatttgatcgggagcttgatggatgaataggagttcacctggccgataagacagcaactaccaaggcttagaggtgtgagaggaggctgtcttacctcactgagtaaggactgcaggcggcttaccttcgagaagagagcttagtgtctgtgtgcacgtgtgtttgtgtgtatgtgtgtgcgtgtgtgcactggcaggagtcccctgctggggcaggagggccgggccatcaccatctttcaccattcacccctgcaccaggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggtaagcaggatggcagggtgggcaagtccaggctggggcttgggaggtctgtgtgaccttgacagtctctcccttctcccttgtctgtgtaaggaggatgacgccaccttaaataggattaaatgagaatggggctctgaaagggctgtgcaatattttcataacgtgtttttatagagacagttgagtatgttctttaagccctcctctctcctaccatgaactaaagatttctgtggaggtcccctcactcccagcaccccctcctcatcccaggccctttttgcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggtgactgtacccctccttcgtgtgtgtgtgtgtgtgtgtgtgtgtgtgtgtgtgtgtgtgtgtgtgtgtgtcagtgctgggccctcagggacccccagcaagcccctccatcctccagactccagctcttctgtaagcttacagggctggccagaccaggagtggggcactcctcacttcacgcggctgggggctgctggagagagccacagcgggaagggtttcctagaggctgcaggacagtgctggatggattttcaatgctcacctgggtgtgagcgtgcggcagggccgcgtgagggtcagcgatctgctactctggactcagccatctctaggcccctctcactcaggtgctccatggttctgggagctgagaaatctcaaaccagcaaaaaagtggaattgatgttgatgctacaggatagtgcacagatgccatctggttgcagcattttggtggaagggcagtgcccagctaggagagtgaggaggggcaggcatttctggcttgaggagatggggtcttaatgctcgtgtgagaggcagagtgggtggagtggagctggctggatccttgctttggcctcctggatttctctctatctccattttgaaaccactctgtgtttggaagaacttttgagtattcagagctgcccactggcagaacagtcttccttgggcaggagtgagctccttgtccccagaaggctgggtctggctggcccctggcagggacactgatgagggtgcttgagttgatcctgtctagtccctttctgtgttttcaaagcccattctaaagcagattcccatttccgtctttgactctaaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggtaggaggctgggcttgccctggggtgaggaggggtctctttctccttatgcacccactgcccgcgaggcttggtcctcacaagtgtgatccatgagactcaagcctgacttgcagttccatactctggttctgccacttccatgccctttgagcctgggcaggtgaccttacttctcctcatctcagcttcctcctccataagagggaaaaaggtattacctgcctcattgtgttgcaaggagatgggcagcatctagggcactggcctggagtatcgcaggtgctttgcctaaggtggtgcagtccaggagaggcagctccagagagaggcccccggctggggctgaaaggagggcagacctcggtttgaatttcaccctgccgctctatagctgtgtgacttgggcaaattacttaacatctctgtatgaggaaatgatgagtgctaagcacttagcttagtgccgggacaatataaattctagctatcgttactattgttttcatcacccgttgctttaaaatccagcctctggtataggcaactattgacgggctaccctgtgtcgaaaacatgcccaggcaggtagcaggaagtcacagatggggacctcttggggcatcaagggatggtgccctgaggctgagctgttctggttgggtggagcatgagaggtctgggaagacagtgggactccagcctggaataagaggctcagagttgattctcgtctgagcacgtccaggggaaccactgagggtttgggaacaggagagtgagggtgagaacctggttctgggcacagcaggctggcatgtaggatggatgttcaggaaagatgagcatagtcaggtggctggtgcccttgtccaggggagaggctccgtcaggttcaggggtcctggcttggagggaagtccgccatgctctaatcacgctcccctttggaagtgctcagccgatgagctcacaggcacatgtcagtttgaagtcatggaatctgactccatgaagcgcacctcaaagagcaccattttgcagctaagggaactgcaggctggacatgctgagtggctgccccgagcccttgcagctaggacatagagaatgctagtaaccacaaccctaccatgttcagagcacatgccaggctccatgctggggcttcgcacgtgtcatcttcacagtgtccctgtgagtaggtgtggtttctctttccatcttacaaatgagtaaacagagcctcagtgtagctaagtaaccactattttaggtttcttagccaatgggtgtgtctgactcctaagcccatggagggcattctgaggtggttcagacagaccccggcttacccttgaacttctgcctgctggctgcatagggaggggctggggggagtttgagcatctcaggccatagagcccctgcctcactgtctccatctctgggtggaaagatggtgttttccctgagaaactaaggctcagagaggttgaatggctctcccaaggtcacacagctggtcagctgcagagttgagaacacaggagtcctggtgctcaggccagcatctctttttttctttgagttgtttctaggtttcctagctcttgcctcagaccttaaagagagagggtctgatggggatgggcactggagacggagcatcccagcatttcacatctgagctggctttcctctgccccaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaagaggcccgtgaggccgggtgggtggggtgctgcgtgtctctcctgcacagcttttctgtgtcagtttgtgccaccaccataccgccatgcatcagggtggcggtttgccaggtagatgctgtgggcagcttccgccattgtgtggacagcatgtatatgtgtctctgtgtggctgggtctgtttttgcttttgtccagatcagtaaggtttgctacctgggtaccccactccacttggagtagaatgtgcataaatatggcataaagaaatgcaatatgcatgcatttattgattgatctatttttttctgagatggggtcttgctgtgttgcccaggctggtctcaaattcctgggctcaagcaatcctctggtctcagcctccccaagtgttgggattataggcatgagccgctgcacctggcctctctgatctatttaacaaacctgctgggagggtctcagggtcaggagcagcactgggctctgaggacacagagctcactcagccgtgacccagagggggtgcctgagctgcatgctgaaggttgttagcatgaccagcaaggcaagaaaaggccctgccgagattagcaaggcatgtgccaagccctggaatgtgacagccgggccttctagaaacctgagtgtataactctccttaaaagccagtaggagctcctcaaaaggcagccctaaggagtccactcttaaatgaactcagagtcagttttaaaatgcaagtctgtgttgattctggtctggatggtgcattcctcgagagcaaaagacagtcttggtcttggatccacttgccctgggtacactgagggctgctaggttccaggtgctcttcctggcactggggagggatacaggcccaagagacatgctgttctccctcctggagcatctattttagtggaggaagacagaaaacaaaccattaatatagagtactgaaaagatgcgatggagaaaactatagcaaggaagggaatggggtgggagagaggtcaggagaggtctcgctgacaaggtggacgaaacaggccatgaggcagagaacatgttccaggcaaagcaaaggcccccaggtggggatgtgcagggagtaccaggaaaccagagaggtgggaatagttatgagatggggggtgcctcagaggggacagggccaagtcaggtgagacctgagggtcacagtcagcagtgagctggggccatgcaggggtctggcctcagaggagtgtggtctggcctggatctgaacctctcactgtggcctagctgctgagctgagaagagatgacaaggaccttgggcagaagcagggagactggagggaggcggtggagggtccaggcgttggggcggggctcaggctggagtctgaagggagcctgcaggcctggtgggtggatgtgggtgggagagggggaggatggcaccaaggctcgggcccctggacagatggagttgccattaagtgggatggggcaggctatggggccatcagtttcagagggatgagtttggcactggcatggtaggcatctgtctatctccacggccctcaaaccaggcatgaagcaggagctcacgtgtttggtcagccatggtgcagaaccgcctgggtgggaggtgcggggtgggagatacacggttgtgtcccaaatgggctctgagccagcgagggccgtctgcactttggcctcacagaaggatgtcggagggagaaatgaagtgtgggtgggggtcccgggccacgctagacatgtgctttcttttcctcgggctctggcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaac

SEQ ID NO: 6 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 7 - DNA, 14994 bp, Homo sapiens
aatgacaaactgaaaaaatctattgtttgttatatatataacaaagaattagtatccacaatatgtaaataattcctaaaattagtcagaaagagacaaacttaaaaagagggtaacaaggaggggagcaaattatgtacataaccagatgattcgcaaagacggcaacagagatggccagcaaaacaaactagatatatacttgtctattagatttatcaacattttttgcctttttcattaaaagcatttgtaaaaggatataggaaaagaggaactctcatatactcctggcagggatgtaaattggtacaacccttttgaaggacaatctgacaaaagcaatcgtaagttacaagtcaacatctatgaatgtatatgaaaatatttatatacatacatcaccaccataaaagcattttctatacatactgtttataattagaaaattggaaacaaatgattaaaagggggctgattaaattaaggttcatctatataacaggattatgcagctattaaaaaggacgtggtaactctatagacattcataggaaaataaattttaaaatactaagatcctgaatgatatatatatcatgagctattatacataacaagatcccacttgtgttataaaaaattatgtttagtcattcaaagggtctggtatgatagacccaaaatgttaatagagtcgagatttttattttttataggtttttgaaatacctgaattttcacaataagtactttgcacattaaaaatcttagctgggcatggtggctcacgcttgtaatcccagcactctgggaggccaaggtaggcagatcacctgaggtcaggagttcgagaccagtctggccaacatggtgaaaccccgtctctactaaaaatacaaaaattagccaggcttggttgggggtgcctgtaattccagatactcgggaagctgagacaggagaatcgcttgaacccaggagggggaagttgcagtgagctgagatcacgacgctgcactccagcctgggcaacaaagagcaaaactccgtctcaaaaataaataaagaaaaaatctttacatgtccaaagatacggctgttcaactaaaaaatatatatgtataaaacttaacatgttaatagtgaacacacaaaacagtaagatagataaaattattccttcaaagctcacttaacctctggatctacactgtccaaaaagacggtctaatgagacaattgagcacttgataggtgagtggttctaactgagatatgttctcagtataaaacatacaataggatcttcctatacaacattaattaaaaaacaaactattgtagttaaaaaggaaaaaattagagatactatgtaaaaaagagccaaaataccttgtattttatttgaaagacatatctccataagattacacaacctcgtgtaggataaaggactttgctttgcttggaatttaaacaatttaggctcttaaatgtcctaaaattctctgtagctaagaaatttttatattggttcctaggaactaggaatccttaaattaggccctacatttgcttacaagtttattttccttggcataaaattttttagtttttacattactggttatatttgatcagggttctatttaaataggcacaagttcaagcaaagatcagattctgcttttagcagtgtgtactcagacaggaagtattaaaaggcaggcagaaaatcctttataaaattactactttcaatgcattttcccacgttgaaatgcttctgcagtttataattaggcaaattactttaattataatcaataatgctgttcaaattactataagaattatacagatatttataccaagagacaatatactagaaaccaagactacgtgaccattacctctactctgtcagtgttatttgtgagaaattgcacaaattttgcaaaaagtgttagtatcctactacagtaggatataatatagaaggaaataatttcataaagcctgtctttggtactagtgctcagttactttcattaactaaaaaaggggctactcttcaaattcccttctctaaaaagaatgtactatatcaaaagggggtaaacactactacgtatacattctgcacttagaaatccctatatgttgattttatcattctcttattcaataaatattgtttctacaatgtgtaaggcattactgtactaaagcattataaggaatataagttaaaaacacatacaaatcttgccaatcaacagcttatagtgtaataggggagagaagctggcccatctatattctccctcaactagcaagtggatgaaatatcagggtcaatagttataagccacaaaagctgacagcttaattaagagaagttttgaaatatgtatttcatgaccaataattacaactgtaacttttctatttaaagaaggagaaaatttgaatttcttctctagctcaacatacacttctataattccattacatgaaccagagtaaagggtaagatggaaatgaagaatattttcttacccttttgtggttctatattggacacttaaaaatcatacacaacctaatcaaaagatgtaattctttaaaaaggtacgagaccaaaattcagaaaatctagactataacaaaatttctcaatttacattatcttaatatgcaattaattttcaccagtaaaatactatagtatgggtacaaatgcattgattagttctaattacaaaaatggctaatatataatactgtgtagtgtttatgatacatcagataatgttctaagtgctctgaaaatataaacttttaatcttttatacgaccctataaaataggtgttattctcactggagagatgagaaaacaggggttcagagatgtgaagtaatttgaccaaaggtcacaaagctgaagaatatgaaatccgggattctgattcaggcagtcttattccagaatcatgctcttaaccactatggaatactgcctctactgtaactattatacccaaaacccttaatcctaagtcatcaaaaggaagagcctctattttacacaatgaagaggcatttctaagaatagaaatttagggacgagcacagtggcttactcctttaatatcagcactttgagaggctgatatgggaggttcacttgaagtcaggagttcaaggtcagcttgggcaacatagtgaaacacagtctctacaaaatatttaaaaattagctgggtgtggtggcatgcatctatagtctcagctacttgggagacagagggaggaggcttgctcgagcccaggagttcgtggctatagtgagctatgatcatgccactgcactccagcctggacaacagagcaagaccctgtctctaaaaaagaaaagaaatttggaaatggtttattttgtattaacaatttataatttacactgaaatttattatgataaaacttttccctgtgttaaaaagctattaactttatgaaaaatttcttttaggtaaggttgattatatatacccacacacatacacaggttaaaagttagtttcatgtgacataataactagcattttgagcactacctgtttgcccagcactgttctaagtgctctacatgtattattgttaaattatcataacactatgaattatgtactataattaccccagctttacagatgaggagactaatccatggggaggttaagtaacttgtccaaggccagacagctagagccggcttttggacccacaccacagtctgactccagcacccatattcttaacaatttcaccatattaatatgtcaagattaagcagttttaaaggatgctattttctcacaaatttcttaatatgaacactcaataagaataatcactaatataagcatttagtatttttttaacactaagttggaagcatagtggaacatttatttttagaaatattattaattggctgggctcacgcttgtaatcggctgggctcatgcctgtaaattttgggaggccaaggtaaaagaattgcttgagcccagtatttccagaccagcatgggcaatacattaagacatcatctttaaaaaaaaaatgttattaatctcctctttttgttaaatgtatattatcaaaattgttactaagctaacaaacttcagaaaaacttatgatgggcaagctgcttgtgacattgaaggtatttaagattcaattctagtttggtcctagatgaccacatatccattgttccttcaacgagcacatggtaaagagcctagaacacagagacacagaacacagtggagaaaagggagtgaaatgtctttaatgacacttactatatatgggattttgtgacaatatacaaggatggttaagacatataaggtgatgcaaaaaaacatattaacaattatagtgacaaaaaatgaggagcatataattatacattgatttatacagagtaccagaggaacacagcattgagagccgtaacaccacctgagggagtggagaaaggcttcagagagaaagtgttttttggaatggatcactgtttccaaaagaactaaagtacagtttgagaaatgcatacttaattcattacttttttcccctcaactttaataataaatttacccaacaaaaaagtttatttttgacttgtaaatctcttaaaatcataaaaaagtaaaattagcttttaaaaacaggtagtcaccatagcattgaatgtgtagtttataatacagcaaagttaaatacaatttcaaattacctattaagttagttgctcatttctttgatttcatttagcattgatctaactcaatgtggaagaaggttacattcgtgcaagttaacacggcttaatgattaactatgttcacctaccaaccttaccttttctgggcaaatattggtatatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaagtaagtagaaaataaagagggttcatgtttatgttttcaatgtggatcttttaaaaaaaatatttctaaggcatgccatttgaaatactttgttgcattgttgaaatacttttttttccaagaaaaataatctccagaaaataaaatttcctattataatttcaagttagttttttgtttccctaatgttatatatgaaaacactgaaaatttgcattttatatgaaaattacaaatcggttaaattatacaatctagaacactatgtcattacactattgtaaattactgaaggtaagtaaaaagttaaaaaaaatttaaaactattctccagtgtttaaaacagattaaataatacagtaaatggaaaagatttattcatatgaaaatatgctgggctttttcttttaattgaagttcagaaaatcaaattttagagatagtacaatttaaataaaatgttaaggacaaaaatatgtgctatttgaaagaagcatacaaggggaaggaattgccaatattcatttttcaaatccattattagtttaaaaatttagattatgatagtgttacaggaaattaatagaaaagaaagaggaaagcaacttataaccaacctactctctatatccagacttttgtagaaaaacaagataatagcatcaaagaccttctccagaccgtggaagaccaatataaacaattaaaccaacagcatagtcaaataaaagaaatagaaaatcaggtaagtcagtattttaatggtatgtcccatctttcacacaggtctgtaaaaacactgaatcctaaaattatttacaagctttaactggatcatgagtaaaattatcacatcagcataactgttaaaattgcaggctctgaagctaataaactacctgcatttaaaccatggctctaaaactttgtgtgaccttgaataaattacttcacccctttatctctcagtttcctcacatatactacaaagataataacagaacttataggattattgtaagaaaaaaaattaattcatagcagccaatgtcatcttactaaaattcaaattagatcatgtttctctttgctcaaaaccacacaatagctttccatttcactcatattggctctttagaccaagattacccaacccttcgtcatctcactgacttcacctcctctactctagttattctgaccgctttaccagtattcaaacacatcaaacatactgccacctcaaagcctttgcccttgttgtttcctctaactggaacgctcttctgccctggtatctacgtggcccactctctgatttcccttagggtcgttatcaaacaaaaaattcccaatgaagacttacaaggtcacttaaccaaaaatcacaaccgcctggtcccatccctgaaaacttctacttccttagctacttttctcctgcacactcacctttatttaacataacataaattttagttatttatctcttctattcctgcactaaaatgtaagctctgtgaatacagggattttttccattatcttcatattttccattatttgtatatactccagaatatagaatactgtatggcacacagtaggcatttctgttgaattaataaatgtaatgtcatattcacacagaagcgtgtgctatgattattattacttggattactagaaatagtgtgcctcataattaaaggtcaacattcaacaatgtaattaatctacaatgtaaacatctggtgaagtgacagagggaagcacttgtttagaaaaaagctatgtcagaatccatgtattctaatatgcagtacaatagtttaaaaatattaataatactctcaaacagctattcaagaggattcaaaaaacataatataaactcagagaaactggtaaacaaaatcattttcaagagatataaaacaaatattattaccaatttccactaaacaaacataatgttagtagtgctgctaaaaggttttttatcaactacttttggtttccatactttccttcttatgatgttattattctaaattcttttcaattatatcttttactatgattaaatgaacctgctccccaaagcaaaatgttactatagtaatatacattgtgtctaaaaataaaaatgtgtgaagaaaccaaaacaatgaatttctgagttggaagaagagttagatcatttaactttctcatatttaaattaaaaaaacaaaactctaaaaatttaagtaactttaagatcacatagttacttagtagaaaagagtaatacccagcaagcaaactttacaatagatccttttaaataaggtcctaggaaatatcattcatgccagcatcaaaaaactaacactaataatgcaagatattatatattctgcttttcttactgtcaatgagaaaaactatcattcaataaattgcaaacccaacacacttaaataaaaataaaatgttactgctaaactaacgataaactactgaatatatagaaagtaagcaaacaaacttgccaacctgccaacatctacagatatgtttacaggtcaaaaattatcaaattatcaagaaagcctggttcaaattatgtattatgtctttatcacaggtctgaagatcagtaagacctaaaactgaaaattattaaacttaaaatctgaacagaatatcaaatatattttattcatataaataaaagaatacattacaatattctaagcaaagcagtctctacttttggccttgctctgttttccgaccaatgtctgcttttttgccttgctttatttttttatcttattaaataatgtccctgattaaatattttgagaacaggtaatctgtacaatctgaataacactgtttatctaaatatcaaacaccgttataacattatgaactgaaagacaaactgtacttctgacatccttactcagatttcccctaattgtatattcagtatcattttaaaaaacagatttatattcttttatcagctcagaaggactagtattcaagaacccacagaaatttctctatcttccaagccaagagcaccaagaactactccctttcttcagttgaatgaaataagaaatgtaaaacatgatggtaagacactttggtgggtttccttcttgaagctattattatcaaattccctattcttaggacttgttctagactaaaagatagttaagagatatccatcaaatacaatgtatcaacctaaactggatgctggggttctttttacaccctataaaagacatacctaagacaatcagagaaatacaaatatggacttgattattagataatatagaaggtttattaattttcttagatgtgatcatggtattgcagttttaaaggagaacaatctcctgtttaagagatacatgctgaaatatttacggagttaaaggtcactggactccagactggtgatagaacaagactctgtctctaaaaaataattaattttttaaaagaaaatagtttggtaagatgattcttacattcttaaataacacgccatctaagaaaaatgctttaacataaacattactgaaaaaatgctacatttgccacaacttcataaaatgtcaagtgaaatctcaagctccaaagatattattcctattactaaatctgatgtaataacattttattgattctaggcattcctgctgaatgtaccaccatttataacagaggtgaacatacaagtggcatgtatgccatcagacccagcaactctcaagtttttcatgtctactgtgatgttatatcaggtaaaacctgtctaaggagaatagacagtagttagttcaacttactcattacgtattaggaagattaacctggttatcattgttttatacatatatatatgaaatatatatgagtattcgtataaatataatacttttaccttgtttatgtatttactcaatattctccttttcctctaaaataatctgaagtgactattatcaataagtttactatgccaaaattcattaattgcctttcacttaacttttgggaccataataaataataaaatgtattgccataacattaataaactaccttacaaaaccaccaattaaaatcaaacaaacaaaaaagtgttatttacatctgtcaacataaatctactaaaaatacatgatttcattcattatattcaggtagtccatggacattaattcaacatcgaatagatggatcacaaaacttcaatgaaacgtgggagaactacaaatatggttttgggaggcttgatggtaaggggactacattcaatcattcattcacttgctaatctacaaatatttactgagaacctcttatggaccaggtattaggaaaagtagtaacgaacgagaagcagtctcagccttcatataatttattatcaaacaattacacatttgttagtaaattacacttattacaactgttattatttgaattatatttatcacaattacatgtctgttcttaaatatacttatcacaatttaattccacggcttacaatgatcataactataattattaaagacaattttgattaaatgttatgtcataagtagtaactgttacaaataagctgtgaaaagaaccactcctagcattagtcactctattctctcattaacgttttacatatcaattaattggaagttaaaaggaccaggaaactcagacatacagtatacattttaaaatttcaattatttaaatataatatatagaatgtatggcttataatgaattagttaactcaatgcaaattattctattttgattacaaatagtaaaataagcaagataaaataacagatgtttaaaatccaaaaagcacatacaaaaatccatgaatgatgtctaagtactcacttataaagtagaagacattcattattatatcaaatttttaaatgctcagtactatttgaccatttaaaaattttgtattcaaactaccagtgaaagccctacctagaaggtatactcagtgataagttttgtagctccaaatcttctaatagtgagtgtaaccccaaaataaaaggctgacaggtaagtcgagaatactcacttaattctggtaagaaagcaacccatttgtacttgtatttaccagcaatccttaaaatgaagcttcctactaactcaatagcaataagacaatagtgaatgtttaatgaaaacagtattttataaatactttaataaaaaggattgtgatgaagaacaatctatttatatttgttatttgtttttaattccaataaaaataatttttaaaattacagaaaaaagttattaagaaccatgcttttaaatttaaaatgattttttaaatttattcctgtctttttctacaaagaaagcatacattaagcaaataccaaaggccaggtttacatttgaagaaagtgacattattattactcaagtctctaggaatacttaacacatctcttgactgtatatggatgttaataaatagctgacagtaaagtttatccatataaagacttgcaaatattcctctaccaatgacgagactttaaaatatctataataatgtaacacatttcactggtgaaacatgtcttgtcatatgcattatagaaaggataatcagactttcagttatattaatatttttaacatttttgtgcacatagctatcttcaataaaattgttttaaaaggtattattttaagatacactaaaatgatcaagggattcaagactaaacaactcaattagttgcaccaataaaaaacacttaaaaaaactgtcagtgtccaacctgtacttaataactcacagatttttaaaacttttcttttcaggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaataagcgttttctctctagacgaaaacctcttaactataatgaaagtgttcattctagttcaatcaggtattttacctctaatcttcctcagattttctattttttggtagtgtatagattatttatacagattatttaaaattgggacttatacagattatttaaaactgggatacatgcatctaaaacactgtaatatttataagaaaggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaaaaaaaaaaaaactctcataggacatgtttcattttgttcctttcaggagtagtaaattagacgttttccccatataaagcttttttctaccagaaagatacttctggtagaagaagagaaaggagctctttatggttcacacgactgtctcctgtcctaactactttgcttaaagtgctcaaattccatcactactcacagttgtctaatctaagtctaatcccctttgatctctcagactaccttcccttttatctctctactacttaataataagaatatctttttttcaaacttgaccttcattttgctttcacaatactatactctccatggattatcccttatctgaatccatctttataaccctattcctttctcatatttagtactgtgggccaatggacaaccttcaatcatcttttctacactgaccctcagacattctatctgctctcacggactcctttatttaccatgaataaagttccaaaatctacatattcatcccaagtctctttccagttccccttcttacattgcctatttgccatttctcccttcaataccctatacttcactcaaattcaacataccaaaaataaaaggccaggcacggtggctcacacctgtaatcccaggactttgggaggctgaggcaggtggatcacctgaggtcaggagtctgaccagcctgaccaatatggtgaaaccccgtctctacctaaaatacaaaaattagccaggcgtggtggcatgtgcctacagtcccagctactcaagaggctgagacaggagaatcgcttgaacccaggaggcggaggttgcagtgagctgagatcacaccaatgcactgggtgacagaacaagactgactcaaaaaaaaataaataacaaattccccagccccttactgctactgctatccctttctacccacctttccctcctttatactctttcacaccatcttcctcacttctttatatccattaatatgaccagcatgttcccagtcacagaagcctggaacccggaagacatctctggcttttcactcaactttgtaaactacctcttttgtatcataagccaccaagttcaatacaatcttctcttgaaacgtctcttaatcttataagctttcttccccaaagactgtctttaacttcagtgctagattatataagt

SEQ ID NO: 8 - protein, 460 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 9 - RNA, 100 nt, Artificial Sequence
  Description of Artificial Sequence: Synthetic polynucleotide
cccgcaccuuggcgcagcggguuuuagagcuagaaauagcaaguuaaaauaaggcuaguccguuaucaacuugaaaaaguggcaccgagucggugcuuuu

SEQ ID NO: 10 - RNA, 100 nt, Artificial Sequence
  Description of Artificial Sequence: Synthetic polynucleotide
cccgcaccuuggcgcagcggguuuuagagcuagaaauagcaaguuaaaauaaggcuaguccguuaacaacuugaaaaaguggcaccgagucggugcuuuu

SEQ ID NO: 11 - RNA, 103 nt, Artificial Sequence
  Description of Artificial Sequence: Synthetic polynucleotide
cccgcaccuuggcgcagcggguuuuagagcuagaaauagcaaguuaaaauaaggcuaguccguuaucaacuugaaaaaguggcaccgagucggugcuuuuuuu

SEQ ID NO: 12 - RNA, 101 nt, Artificial Sequence
  Description of Artificial Sequence: Synthetic polynucleotide
ccgcaccuuggcgcagcgguuuuagagcuagaaauagcaaguuaaaauaaggcuaguccguuaucaacuugaaaaaguggcaccgagucggugcuuuuuuu

SEQ ID NO: 13 - DNA, 20 bp, Artificial Sequence
  Description of Artificial Sequence: Synthetic oligonucleotide
cccgcaccttggcgcagcgg

SEQ ID NO: 14 - DNA, 20 bp, Artificial Sequence
  Description of Artificial Sequence: Synthetic oligonucleotide
aagatacctgaataactctc

SEQ ID NO: 15 - DNA, 20 bp, Artificial Sequence
  Description of Artificial Sequence: Synthetic oligonucleotide
aagatacctgaataaccctc

SEQ ID NO: 16 - protein, 84 aa, Unknown
  Description of Unknown: Bacillus phage PBS2 sequence
MTNLSDIIEKETGKQLVIQESILMLPEEVEEVIGNKPESDILVHTAYDESTDENVMLLTSDAPEYKPWALVIQDSNGENKIKML

SEQ ID NO: 17 - protein, 16 aa, Artificial Sequence
  Description of Artificial Sequence: Synthetic peptide
SGSETPGTSESATPES

SEQ ID NO: 18 - protein, 4 aa, Artificial Sequence
  Description of Artificial Sequence: Synthetic peptide
SGGS

SEQ ID NO: 19 - protein, 24 aa, Artificial Sequence
  Description of Artificial Sequence: Synthetic peptide
SGGSSGSETPGTSESATPESSGGS

SEQ ID NO: 20 - protein, 32 aa, Artificial Sequence
  Description of Artificial Sequence: Synthetic polypeptide
SGGSSGGSSGSETPGTSESATPESSGGSSGGS

SEQ ID NO: 21 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 22 - protein, 5 aa, Artificial Sequence
  Description of Artificial Sequence: Synthetic peptide
GGGGS

SEQ ID NO: 23 - protein, 24 aa, Artificial Sequence
  Description of Artificial Sequence: Synthetic peptide
SGGSSGGSSGSETPGTSESATPES

SEQ ID NO: 24 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 25 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 26 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 27 - protein, 7 aa, Macaca mulatta polyomavirus 1
PKKKRKV

SEQ ID NO: 28 - protein, 30 aa, Unknown
  Description of Unknown: NLS sequence
MDSLLMNRRKFLYQFKNVRWAKGRRETYLC

SEQ ID NO: 29 - protein, 36 aa, Unknown
  Description of Unknown: Zn -coordinating motif sequence
  MOD_RES (2)..(2): Any amino acid
  MOD_RES (4)..(29): Any amino acid
  SITE (4)..(29): This sequence may encompass 23-26 residues
  MOD_RES (32)..(35): Any amino acid
  SITE (32)..(35): This sequence may encompass 2-4 residues
HXEXXXXXXXXXXXXXXXXXXXXXXXXXXPCXXXXC

SEQ ID NO: 30 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 31 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 32 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 33 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 34 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 35 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 36 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 37 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 38 - protein, 1368 aa, Streptococcus pyogenes [sequence omitted]

SEQ ID NO: 39 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - protein, 120 aa, Artificial Sequence
  Description of Artificial Sequence: Synthetic polypeptide
  SITE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 42 - protein, 120 aa, Artificial Sequence
  Description of Artificial Sequence: Synthetic polypeptide
  SITE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 43 - protein, 150 aa, Artificial Sequence
  Description of Artificial Sequence: Synthetic polypeptide
  SITE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 44 - protein, 30 aa, Artificial Sequence
  Description of Artificial Sequence: Synthetic polypeptide
  SITE (1)..(30): This sequence may encompass 1-30 residues
GGGGGGGGGGGGGGGGGGGGGGGGGGGGGG

SEQ ID NO: 45 - protein, 150 aa, Artificial Sequence
  Description of Artificial Sequence: Synthetic polypeptide
  SITE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 46 - protein, 90 aa, Artificial Sequence
  Description of Artificial Sequence: Synthetic polypeptide
  SITE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 47 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  SITE (1)..(60): This sequence may encompass 1-30 "Xaa Pro" repeating units
XPXPXPXPXPXPXPXPXPXPXPXPXPXPXPXPXPXPXPXPXPXPXPXPXPXPXPXPXPXP

SEQ ID NO: 48 - protein, 5 aa, Artificial Sequence
  Description of Artificial Sequence: Synthetic peptide
EAAAK

SEQ ID NO: 49 - protein, 4 aa, Artificial Sequence
  Description of Artificial Sequence: Synthetic peptide
SGGS

SEQ ID NO: 50 - DNA, 20 bp, Artificial Sequence
  Description of Artificial Sequence: Synthetic oligonucleotide
gccaatggcctccttcagtt

SEQ ID NO: 51 - protein, 21 aa, Artificial Sequence
  Description of Artificial Sequence: Synthetic peptide
  SITE (1)..(21): This sequence may encompass 1, 3 or 7 "Gly Gly Ser" repeating units
GGSGGSGGSGGSGGSGGSGGS

SEQ ID NO: 52 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 53 - protein, 1300 aa, Francisella sp.
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 54 - protein, 1140 aa, Bacillus sp.
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 55 - RNA, 100 nt, Artificial Sequence
  Description of Artificial Sequence: Synthetic polynucleotide
cagguuccaugggaugcucuguuuuagagcuagaaauagcaaguuaaaauaaggcuaguccguuaucaacuugaaaaaguggcaccgagucggugcuuuu

SEQ ID NO: 56 - RNA, 20 nt, Artificial Sequence
  Description of Artificial Sequence: Synthetic oligonucleotide
cagguuccaugggaugcucu

SEQ ID NO: 57 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 58 - DNA, 100 bp, Artificial Sequence
  Description of Artificial Sequence: Synthetic oligonucleotide
  Description of Combined DNA/RNA Molecule: Synthetic oligonucleotide
cccgcaccttggcgcagcggguuuuagagcuagaaauagcaaguuaaaauaaggcuaguccguuaucaacuugaaaaaguggcaccgagucggugcuuuu

SEQ ID NO: 59 - RNA, 100 nt, Artificial Sequence
  Description of Artificial Sequence: Synthetic polynucleotide
aagauaccugaauaacccucguuuuagagcuagaaauagcaaguuaaaauaaggcuaguccguuaucaacuugaaaaaguggcaccgagucggugcuuuu

SEQ ID NO: 60 - RNA, 100 nt, Artificial Sequence; identical to SEQ ID NO: 59
  Description of Artificial Sequence: Synthetic polynucleotide

SEQ ID NO: 61 - RNA, 80 nt, Artificial Sequence; identical to SEQ ID NO: 57
  Description of Artificial Sequence: Synthetic oligonucleotide

SEQ ID NO: 62 - DNA, 3166 bp, Homo sapiens
ctgctcagttcatccctagaggcagctgctccaggtaatgccctctggggaggggaaagaggaggggaggaggatgaagaggggcaagaggagctccctgcccagcccagccagcaagcctggagaagcacttgctagagctaaggaagcctcggagctggacgggtgccccccacccctcatcataacctgaagaacatggaggcccgggaggggtgtcacttgcccaaagctacacagggggtggggctggaagtggctccaagtgcaggttcccccctcattcttcaggcttagggctggaggaagccttagacagcccagtcctaccccagacagggaaactgaggcctggagagggccagaaatcacccaaagacacacagcatgttggctggactggacggagatcagtccagaccgcaggtgccttgatgttcagtctggtgggttttctgctccatcccacccacctccctttgggcctcgatccctcgcccctcaccagtcccccttctgagagcccgtattagcagggagccggcccctactccttctggcagacccagctaaggttctaccttaggggccacgccacctccccagggaggggtccagaggcatggggacctggggtgcccctcacaggacacttccttgcaggaacagaggtgccatgcagccccgggtactccttgttgttgccctcctggcgctcctggcctctgcccgtaagcacttggtgggactgggctgggggcagggtggaggcaacttggggatcccagtcccaatgggtggtcaagcaggagcccagggctcgtccagaggccgatccaccccactcagccctgctctttcctcaggagcttcagaggccgaggatgcctcccttctcagcttcatgcagggttacatgaagcacgccaccaagaccgccaaggatgcactgagcagcgtgcaggagtcccaggtggcccagcaggccaggtacacccgctggcctccctccccatcccccctgccagctgcctccattcccacccgcccctgccctggtgagatcccaacaatggaatggaggtgctccagcctcccctgggcctgtgcctcttcagcctcctctttcctcacagggcctttgtcaggctgctgcgggagagatgacagagttgagactgcattcctcccaggtccctcctttctccccggagcagtcctagggcgtgccgttttagccctcatttccattttcctttcctttccctttctttctctttctatttctttctttctttctttctttctttctttctttctttctttctttctttctttctttctttctttcctttctttctttcctttctttctttcctttctttctttctttcctttctttctctttctttctttctttcctttttctttctttccctctcttcctttctctctttctttcttcttcttttttttttaatggagtctccctctgtcacctaggctggagtgcagtggtgccatctcggctcactgcaacctccgtctcccgggttcaacccattctcctgcctcagcctcccaagtagctgggattacaggcacgcgccaccacacccagctaatttttgtatttttagcagagatggggtttcaccatgttggccaggttggtcttgaattcctgacctcaggggatcctcctgcctcggcctcccaaagtgctgggattacaggcatgagccactgcgcctggccccattttccttttctgaaggtctggctagagcagtggtcctcagcctttttggcaccagggaccagttttgtggtggacaatttttccatgggccagcggggatggttttgggatgaagctgttccacctcagatcatcaggcattagattctcataaggagccctccacctagatccctggcatgtgcagttcacaatagggttcacactcctatgagaatgtaaggccacttgatctgacaggaggcggagctcaggcggtattgctcactcacccaccactcacttcgtgctgtgcagcccggctcctaacagtccatggaccagtacctatctatgacttgggggttggggacccctgggctaggggtttgccttgggaggccccacctgacccaattcaagcccgtgagtgcttctgctttgttctaagacctggggccagtgtgagcagaagtgtgtccttcctctcccatcctgcccctgcccatcagtactctcctctcccctactcccttctccacctcaccctgactggcattagctggcatagcagaggtgttcataaacattcttagtccccagaaccggctttggggtaggtgttattttctcactttgcagatgagaaaattgaggctcagagcgattaggtgacctgccccagatcacacaactaatcaatcctccaatgactttccaaatgagaggctgcctccctctgtcctaccctgctcagagccaccaggttgtgcaactccaggcggtgctgtttgcacagaaaacaatgacagccttgacctttcacatctccccaccctgtcactttgtgcctcaggcccaggggcataaacatctgaggtgacctggagatggcagggtttgacttgtgctggggttcctgcaaggatatctcttctcccagggtggcagctgtgggggattcctgcctgaggtctcagggctgtcgtccagtgaagttgagagggtggtgtggtcctgactggtgtcgtccagtggggacatgggtgtgggtcccatggttgcctacagaggagttctcatgccctgctctgttgcttcccctgactgatttaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 63 - protein, 99 aa, Homo sapiens
MQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 64 - protein, 4548 aa, Homo sapiens
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 65 - RNA, 100 nt, Artificial Sequence; identical to SEQ ID NO: 10
  Description of Artificial Sequence: Synthetic polynucleotide

SEQ ID NO: 66 - DNA, 20 bp, Artificial Sequence
  Description of Artificial Sequence: Synthetic oligonucleotide
ggtgctagccttgcgttccg

SEQ ID NO: 67 - DNA, 20 bp, Artificial Sequence
  Description of Artificial Sequence: Synthetic oligonucleotide
gcttacctgtctgtggaagc

SEQ ID NO: 68 - DNA, 20 bp, Artificial Sequence
  Description of Artificial Sequence: Synthetic oligonucleotide
tgcttacctgtctgtggaag

SEQ ID NO: 69 - DNA, 20 bp, Artificial Sequence
  Description of Artificial Sequence: Synthetic oligonucleotide
cccataccttggagcaacgg

SEQ ID NO: 70 - DNA, 23 bp, Artificial Sequence
  Description of Artificial Sequence: Synthetic oligonucleotide
ccagccaagcgcacctaatttcc

SEQ ID NO: 71 - RNA, 98 nt, Artificial Sequence
  Description of Artificial Sequence: Synthetic oligonucleotide
ggaaauuaggugcgcuuggcguuuuagagcuagaaauagcaaguuaaaauaaggcuaguccguuaucaacuugaaaaaguggcaccgagucggugcuu

SEQ ID NO: 72 - RNA, 100 nt, Artificial Sequence
  Description of Artificial Sequence: Synthetic polynucleotide
ggcgcauaaagaugagacgcguuuuagagcuagaaauagcaaguuaaaauaaggcuaguccguuaucaacuugaaaaagugucaccgagucggugcuucg

SEQ ID NO: 73 - RNA, 100 nt, Artificial Sequence; identical to SEQ ID NO: 55
  Description of Artificial Sequence: Synthetic polynucleotide

SEQ ID NO: 74 - RNA, 118 nt, Artificial Sequence
  Description of Artificial Sequence: Synthetic polynucleotide
ggcgcauaaagaugagacgcguuuuagagcuaugcuguuuugaaaaaaacagcauagcaaguuaaaauaaggcuaguccguuaucaacuugaaaaaguggcaccgagucggugcuuuu

SEQ ID NO: 75 - DNA, 29 bp, Artificial Sequence
  Description of Artificial Sequence: Synthetic oligonucleotide
gctgcgccaaggcgcgggtgtagggatgg

SEQ ID NO: 76 - DNA, 27 bp, Artificial Sequence
  Description of Artificial Sequence: Synthetic oligonucleotide
  modified_base (11)..(11): a, c, t, g, unknown or other
  modified_base (13)..(13): a, c, t, g, unknown or other
ggttattcagncntctttttctgatac

SEQ ID NO: 77 - DNA, 33 bp, Artificial Sequence
  Description of Artificial Sequence: Synthetic oligonucleotide
acacccgcaccttggcgcagcggtggaaggtgg

SEQ ID NO: 78 - DNA, 33 bp, Artificial Sequence
  Description of Artificial Sequence: Synthetic oligonucleotide
acacccgcaccttggcgcaggggggaggggggg

SEQ ID NO: 79 - DNA, 33 bp, Artificial Sequence
  Description of Artificial Sequence: Synthetic oligonucleotide
acacccgcgccttggcgcagcggtggaaggtgg

SEQ ID NO: 80 - DNA, 23 bp, Artificial Sequence
  Description of Artificial Sequence: Synthetic oligonucleotide
cccgcaccttggcgcagcggtgg

SEQ ID NO: 81 - DNA, 20 bp, Artificial Sequence
  Description of Artificial Sequence: Synthetic oligonucleotide
caggttccatgggatgctct

SEQ ID NO: 82 - DNA, 20 bp, Artificial Sequence
  Description of Artificial Sequence: Synthetic oligonucleotide
ggtggctcaccagctccagc

SEQ ID NO: 83 - DNA, 20 bp, Artificial Sequence
  Description of Artificial Sequence: Synthetic oligonucleotide
ttggaaagacggaggcagcc

SEQ ID NO: 84 - DNA, 20 bp, Artificial Sequence
  Description of Artificial Sequence: Synthetic oligonucleotide
gaaagacggaggcagcctgg

SEQ ID NO: 85 - DNA, 20 bp, Artificial Sequence
  Description of Artificial Sequence: Synthetic oligonucleotide
tcccaggcctggagtttatt

SEQ ID NO: 86 - DNA, 20 bp, Artificial Sequence
  Description of Artificial Sequence: Synthetic oligonucleotide
agcacctacctcgggagctg

SEQ ID NO: 87 - DNA, 20 bp, Artificial Sequence
  Description of Artificial Sequence: Synthetic oligonucleotide
ctttccaggtcatcacagtt

SEQ ID NO: 88 - DNA, 20 bp, Artificial Sequence
  Description of Artificial Sequence: Synthetic oligonucleotide
cctttccaggtcatcacagt

SEQ ID NO: 89 - DNA, 20 bp, Artificial Sequence
  Description of Artificial Sequence: Synthetic oligonucleotide
tttccaggtcatcacagttg

SEQ ID NO: 90 - DNA, 20 bp, Artificial Sequence
  Description of Artificial Sequence: Synthetic oligonucleotide
cttacctgccccatgggtgc

SEQ ID NO: 91 - DNA, 20 bp, Artificial Sequence
  Description of Artificial Sequence: Synthetic oligonucleotide
taaggcccaagggggcaagc

SEQ ID NO: 92 - DNA, 20 bp, Artificial Sequence
  Description of Artificial Sequence: Synthetic oligonucleotide
cctcttcacctgctcctgag

SEQ ID NO: 93 - DNA, 20 bp, Artificial Sequence
  Description of Artificial Sequence: Synthetic oligonucleotide
gcctcttcacctgctcctga

SEQ ID NO: 94 - DNA, 20 bp, Artificial Sequence
  Description of Artificial Sequence: Synthetic oligonucleotide
ttcacctgctcctgaggggc

SEQ ID NO: 95 - DNA, 20 bp, Artificial Sequence
  Description of Artificial Sequence: Synthetic oligonucleotide
tcacctgctcctgaggggcc

SEQ ID NO: 96 - DNA, 20 bp, Artificial Sequence
  Description of Artificial Sequence: Synthetic oligonucleotide
cccaggctgcagctcccact

SEQ ID NO: 97 - DNA, 20 bp, Artificial Sequence
  Description of Artificial Sequence: Synthetic oligonucleotide
ccccaggctgcagctcccac

SEQ ID NO: 98 - DNA, 20 bp, Artificial Sequence
  Description of Artificial Sequence: Synthetic oligonucleotide
gcaggtgaccgtggcctgcg

SEQ ID NO: 99 - DNA, 20 bp, Artificial Sequence
  Description of Artificial Sequence: Synthetic oligonucleotide
ctcctttaggaggctggtgg

SEQ ID NO: 100 - DNA, 20 bp, Artificial Sequence
  Description of Artificial Sequence: Synthetic oligonucleotide
ttttcaggagaattttggtt

SEQ ID NO: 101 - DNA, 20 bp, Artificial Sequence
  Description of Artificial Sequence: Synthetic oligonucleotide
cttttcaggagaattttggt

SEQ ID NO: 102 - DNA, 20 bp, Artificial Sequence
  Description of Artificial Sequence: Synthetic oligonucleotide
taatttggcccttcgtctta

SEQ ID NO: 103 - DNA, 20 bp, Artificial Sequence
  Description of Artificial Sequence: Synthetic oligonucleotide
agactttgtccataagacga

SEQ ID NO: 104 - DNA, 20 bp, Artificial Sequence
  Description of Artificial Sequence: Synthetic oligonucleotide
gactttgtccataagacgaa

SEQ ID NO: 105 - DNA, 20 bp, Artificial Sequence
  Description of Artificial Sequence: Synthetic oligonucleotide
agccaatggcctccttcagt

SEQ ID NO: 106 - DNA, 20 bp, Artificial Sequence
  Description of Artificial Sequence: Synthetic oligonucleotide
tcccaactgaaggaggccat

SEQ ID NO: 107 - DNA, 20 bp, Artificial Sequence
  Description of Artificial Sequence: Synthetic oligonucleotide
ggcctccttcagttgggaca

SEQ ID NO: 108 - DNA, 20 bp, Artificial Sequence
  Description of Artificial Sequence: Synthetic oligonucleotide
gaccatgtcccaactgaagg

SEQ ID NO: 109 - DNA, 20 bp, Artificial Sequence
  Description of Artificial Sequence: Synthetic oligonucleotide
gccaatggcctccttcagtt

SEQ ID NO: 110 - DNA, 20 bp, Artificial Sequence
  Description of Artificial Sequence: Synthetic oligonucleotide
attgtcttgatcaattctgg

SEQ ID NO: 111 - DNA, 20 bp, Artificial Sequence
  Description of Artificial Sequence: Synthetic oligonucleotide
attctggaggaaataactag

SEQ ID NO: 112 - DNA, 20 bp, Artificial Sequence
  Description of Artificial Sequence: Synthetic oligonucleotide
tctgggtgttctggagtttc

SEQ ID NO: 113 - DNA, 20 bp, Artificial Sequence
  Description of Artificial Sequence: Synthetic oligonucleotide
aacatagcaaatcttgattt

SEQ ID NO: 114 - DNA, 20 bp, Artificial Sequence
  Description of Artificial Sequence: Synthetic oligonucleotide
gtagaattttttcttctagg

SEQ ID NO: 115 - DNA, 20 bp, Artificial Sequence
  Description of Artificial Sequence: Synthetic oligonucleotide
actacaagtcaaaaatgaag

SEQ ID NO: 116 - DNA, 20 bp, Artificial Sequence
  Description of Artificial Sequence: Synthetic oligonucleotide
tatattggtcttccacggtc

SEQ ID NO: 117 - DNA, 20 bp, Artificial Sequence
  Description of Artificial Sequence: Synthetic oligonucleotide
caaagaccttctccagaccg

SEQ ID NO: 118 - DNA, 20 bp, Artificial Sequence
  Description of Artificial Sequence: Synthetic oligonucleotide
ggtcttccacggtctggaga

SEQ ID NO: 119 - DNA, 20 bp, Artificial Sequence
  Description of Artificial Sequence: Synthetic oligonucleotide
ttgtttatattggtcttcca

SEQ ID NO: 120 - DNA, 20 bp, Artificial Sequence
  Description of Artificial Sequence: Synthetic oligonucleotide
cttttatttgactatgctgt

SEQ ID NO: 121 - DNA, 20 bp, Artificial Sequence
  Description of Artificial Sequence: Synthetic oligonucleotide
aaagtctggatatagagagt

SEQ ID NO: 122 - DNA, 20 bp, Artificial Sequence
  Description of Artificial Sequence: Synthetic oligonucleotide
gttggtttaattgtttatat

SEQ ID NO: 123 - DNA, 20 bp, Artificial Sequence
  Description of Artificial Sequence: Synthetic oligonucleotide
tgatggtaagacactttggt

SEQ ID NO: 124 - DNA, 20 bp, Artificial Sequence
  Description of Artificial Sequence: Synthetic oligonucleotide
ggagtagttcttggtgctct

SEQ ID NO: 125 - DNA, 20 bp, Artificial Sequence
  Description of Artificial Sequence: Synthetic oligonucleotide
aacatgatggtaagacactt

SEQ ID NO: 126 - DNA, 20 bp, Artificial Sequence
  Description of Artificial Sequence: Synthetic oligonucleotide
tgaagaaagggagtagttct

SEQ ID NO: 127 - DNA, 20 bp, Artificial Sequence
  Description of Artificial Sequence: Synthetic oligonucleotide
agttcttggtgctcttggct

SEQ ID NO: 128 - DNA, 20 bp, Artificial Sequence
  Description of Artificial Sequence: Synthetic oligonucleotide
atgatggtaagacactttgg

SEQ ID NO: 129 - DNA, 20 bp, Artificial Sequence
  Description of Artificial Sequence: Synthetic oligonucleotide
gaagatagagaaatttctgt

SEQ ID NO: 130 - DNA, 20 bp, Artificial Sequence
  Description of Artificial Sequence: Synthetic oligonucleotide
ggaagatagagaaatttctg

SEQ ID NO: 131 - DNA, 20 bp, Artificial Sequence
  Description of Artificial Sequence: Synthetic oligonucleotide
tatttcattcaactgaagaa

SEQ ID NO: 132 - DNA, 20 bp, Artificial Sequence
  Description of Artificial Sequence: Synthetic oligonucleotide
atttcattcaactgaagaaa

SEQ ID NO: 133 - DNA, 20 bp, Artificial Sequence
  Description of Artificial Sequence: Synthetic oligonucleotide
gtctactgtgatgttatatc

SEQ ID NO: 134 - DNA, 20 bp, Artificial Sequence
  Description of Artificial Sequence: Synthetic oligonucleotide
taaatggtggtacattcagc

SEQ ID NO: 135 - DNA, 20 bp, Artificial Sequence
  Description of Artificial Sequence: Synthetic oligonucleotide
tatcaggtaaaacctgtcta

SEQ ID NO: 136 - DNA, 20 bp, Artificial Sequence
  Description of Artificial Sequence: Synthetic oligonucleotide
tgtaccaccatttataacag

SEQ ID NO: 137 - DNA, 20 bp, Artificial Sequence
  Description of Artificial Sequence: Synthetic oligonucleotide
ttcacctctgttataaatgg

SEQ ID NO: 138 - DNA, 20 bp, Artificial Sequence
  Description of Artificial Sequence: Synthetic oligonucleotide
aacagaggtgaacatacaag

SEQ ID NO: 139 - DNA, 20 bp, Artificial Sequence
  Description of Artificial Sequence: Synthetic oligonucleotide
ttgagagttgctgggtctga

SEQ ID NO: 140 - DNA, 20 bp, Artificial Sequence
  Description of Artificial Sequence: Synthetic oligonucleotide
tgaaaaacttgagagttgct

SEQ ID NO: 141 - DNA, 20 bp, Artificial Sequence
  Description of Artificial Sequence: Synthetic oligonucleotide
ttaattcaacatcgaataga

SEQ ID NO: 142 - DNA, 20 bp, Artificial Sequence
  Description of Artificial Sequence: Synthetic oligonucleotide
tttgggaggcttgatggtaa

SEQ ID NO: 143 - DNA, 20 bp, Artificial Sequence
  Description of Artificial Sequence: Synthetic oligonucleotide
cattatattcaggtagtcca

SEQ ID NO: 144 - DNA, 20 bp, Artificial Sequence
  Description of Artificial Sequence: Synthetic oligonucleotide
ttgggaggcttgatggtaag

SEQ ID NO: 145 - DNA, 20 bp, Artificial Sequence
  Description of Artificial Sequence: Synthetic oligonucleotide
ttttgggaggcttgatggta

SEQ ID NO: 146 - DNA, 20 bp, Artificial Sequence
  Description of Artificial Sequence: Synthetic oligonucleotide
acaaaacttcaatgaaacgt

SEQ ID NO: 147 - DNA, 20 bp, Artificial Sequence
  Description of Artificial Sequence: Synthetic oligonucleotide
tatggttttgggaggcttga

SEQ ID NO: 148 - DNA, 20 bp, Artificial Sequence
  Description of Artificial Sequence: Synthetic oligonucleotide
actacaaatatggttttggg

SEQ ID NO: 149 - DNA, 20 bp, Artificial Sequence
  Description of Artificial Sequence: Synthetic oligonucleotide
gagaactacaaatatggttt

SEQ ID NO: 150 - DNA, 20 bp, Artificial Sequence
  Description of Artificial Sequence: Synthetic oligonucleotide
aggacacttcaactgtccag

SEQ ID NO: 151 - DNA, 20 bp, Artificial Sequence
  Description of Artificial Sequence: Synthetic oligonucleotide
gccgtcctcctcggaacgca

SEQ ID NO: 152 - DNA, 20 bp, Artificial Sequence
  Description of Artificial Sequence: Synthetic oligonucleotide
gctagccttgcgttccgagg

SEQ ID NO: 153 - DNA, 20 bp, Artificial Sequence
  Description of Artificial Sequence: Synthetic oligonucleotide
gcgttccgaggaggacggcc

SEQ ID NO: 154 - DNA, 20 bp, Artificial Sequence
  Description of Artificial Sequence: Synthetic oligonucleotide
gccttgcgttccgaggagga

SEQ ID NO: 155 - DNA, 20 bp, Artificial Sequence
  Description of Artificial Sequence: Synthetic oligonucleotide
ggacgaggacggcgactacg

SEQ ID NO: 156 - DNA, 20 bp, Artificial Sequence
  Description of Artificial Sequence: Synthetic oligonucleotide
ggacggcgactacgaggagc

SEQ ID NO: 157 - DNA, 20 bp, Artificial Sequence
  Description of Artificial Sequence: Synthetic oligonucleotide
cgtcctcgtcctcctgcgca

SEQ ID NO: 158 - DNA, 20 bp, Artificial Sequence
  Description of Artificial Sequence: Synthetic oligonucleotide
gtcctcgtcctcctgcgcac

SEQ ID NO: 159 - DNA, 20 bp, Artificial Sequence
  Description of Artificial Sequence: Synthetic oligonucleotide
ccgtcagctccaggcggtcc

SEQ ID NO: 160 - DNA, 20 bp, Artificial Sequence
  Description of Artificial Sequence: Synthetic oligonucleotide
cgcccgtgcgcaggaggacg

SEQ ID NO: 161 - DNA, 20 bp, Artificial Sequence
  Description of Artificial Sequence: Synthetic oligonucleotide
tcagctccaggcggtcctgg

SEQ ID NO: 162 - DNA, 20 bp, Artificial Sequence
  Description of Artificial Sequence: Synthetic oligonucleotide
cttggcgcagcggtggaagg

SEQ ID NO: 163 - DNA, 20 bp, Artificial Sequence
  Description of Artificial Sequence: Synthetic oligonucleotide
cgtgcgcaggaggacgagga

SEQ ID NO: 164 - DNA, 20 bp, Artificial Sequence
  Description of Artificial Sequence: Synthetic oligonucleotide
ccaggaccgcctggagctga

SEQ ID NO: 165 - DNA, 20 bp, Artificial Sequence
  Description of Artificial Sequence: Synthetic oligonucleotide
tcttggtgaggtatccccgg

SEQ ID NO: 166 - DNA, 20 bp, Artificial Sequence
  Description of Artificial Sequence: Synthetic oligonucleotide
cagtgcgctctgactgcgag

SEQ ID NO: 167 - DNA, 20 bp, Artificial Sequence
  Description of Artificial Sequence: Synthetic oligonucleotide
cttggtgaggtatccccggc

SEQ ID NO: 168 - DNA, 20 bp, Artificial Sequence
  Description of Artificial Sequence: Synthetic oligonucleotide
ggatcttggtgaggtatccc

SEQ ID NO: 169 - DNA, 20 bp, Artificial Sequence
  Description of Artificial Sequence: Synthetic oligonucleotide
gaagatgagtggcgacctgc

SEQ ID NO: 170 - DNA, 20 bp, Artificial Sequence
  Description of Artificial Sequence: Synthetic oligonucleotide
agcaccaccacgtaggtgcc

SEQ ID NO: 171 - DNA, 20 bp, Artificial Sequence
  Description of Artificial Sequence: Synthetic oligonucleotide
ggtcgccactcatcttcacc

SEQ ID NO: 172 - DNA, 20 bp, Artificial Sequence
  Description of Artificial Sequence: Synthetic oligonucleotide
ctccttcagcaccaccacgt

SEQ ID NO: 173 - DNA, 20 bp, Artificial Sequence
  Description of Artificial Sequence: Synthetic oligonucleotide
gagtggcgacctgctggagc

SEQ ID NO: 174 - DNA, 20 bp, Artificial Sequence
  Description of Artificial Sequence: Synthetic oligonucleotide
gcgcactgcccgccgcctgc

SEQ ID NO: 175 - DNA, 20 bp, Artificial Sequence
  Description of Artificial Sequence: Synthetic oligonucleotide
ggcttcctggtgaagatgag

SEQ ID NO: 176 - DNA, 20 bp, Artificial Sequence
  Description of Artificial Sequence: Synthetic oligonucleotide
cacctacgtggtggtgctga

SEQ ID NO: 177 - DNA, 20 bp, Artificial Sequence
  Description of Artificial Sequence: Synthetic oligonucleotide
ctacgtggtggtgctgaagg

SEQ ID NO: 178 - DNA, 20 bp, Artificial Sequence
  Description of Artificial Sequence: Synthetic oligonucleotide
atggaagacatgcaggatct

SEQ ID NO: 179 - DNA, 20 bp, Artificial Sequence
  Description of Artificial Sequence: Synthetic oligonucleotide
agacatgcaggatcttggtg

SEQ ID NO: 180 - DNA, 20 bp, Artificial Sequence
  Description of Artificial Sequence: Synthetic oligonucleotide
ctcatcttcaccaggaagcc

SEQ ID NO: 181 - DNA, 20 bp, Artificial Sequence
  Description of Artificial Sequence: Synthetic oligonucleotide
ctcctcgatgtagtcgacat

SEQ ID NO: 182 - DNA, 20 bp, Artificial Sequence
  Description of Artificial Sequence: Synthetic oligonucleotide
tattcatccgcccggtaccg

SEQ ID NO: 183 - DNA, 20 bp, Artificial Sequence
  Description of Artificial Sequence: Synthetic oligonucleotide
tcctcgatgtagtcgacatg

SEQ ID NO: 184 - DNA, 20 bp, Artificial Sequence
  Description of Artificial Sequence: Synthetic oligonucleotide
cctcctcgatgtagtcgaca

SEQ ID NO: 185 - DNA, 20 bp, Artificial Sequence
  Description of Artificial Sequence: Synthetic oligonucleotide
gccccatgtcgactacatcg

SEQ ID NO: 186 - DNA, 20 bp, Artificial Sequence
  Description of Artificial Sequence: Synthetic oligonucleotide
ccatgtcgactacatcgagg

SEQ ID NO: 187 - DNA, 20 bp, Artificial Sequence
  Description of Artificial Sequence: Synthetic oligonucleotide
ggggctggtattcatccgcc

SEQ ID NO: 188 - DNA, 20 bp, Artificial Sequence
  Description of Artificial Sequence: Synthetic oligonucleotide
gtcgacatggggcaacttca

SEQ ID NO: 189 - DNA, 20 bp, Artificial Sequence
  Description of Artificial Sequence: Synthetic oligonucleotide
accaccgggaaatcgagggc

SEQ ID NO: 190 - DNA, 20 bp, Artificial Sequence
  Description of Artificial Sequence: Synthetic oligonucleotide
gagtgaccaccgggaaatcg

SEQ ID NO: 191 - DNA, 20 bp, Artificial Sequence
  Description of Artificial Sequence: Synthetic oligonucleotide
agtgaccaccgggaaatcga

SEQ ID NO: 192 - DNA, 20 bp, Artificial Sequence
  Description of Artificial Sequence: Synthetic oligonucleotide
ccaccgggaaatcgagggca

SEQ ID NO: 193 - DNA, 20 bp, Artificial Sequence
  Description of Artificial Sequence: Synthetic oligonucleotide
gaagcgggtcccgtcctcct

SEQ ID NO: 194 - DNA, 20 bp, Artificial Sequence
  Description of Artificial Sequence: Synthetic oligonucleotide
ctaggagatacacctccacc

SEQ ID NO: 195 - DNA, 20 bp, Artificial Sequence
  Description of Artificial Sequence: Synthetic oligonucleotide
cagcatacagagtgaccacc

SEQ ID NO: 196 - DNA, 20 bp, Artificial Sequence
  Description of Artificial Sequence: Synthetic oligonucleotide
aagcgggtcccgtcctcctc

SEQ ID NO: 197 - DNA, 20 bp, Artificial Sequence
  Description of Artificial Sequence: Synthetic oligonucleotide
tgaccctgccctcgatttcc

SEQ ID NO: 198 - DNA, 20 bp, Artificial Sequence
  Description of Artificial Sequence: Synthetic oligonucleotide
cactctgtatgctggtgtct

SEQ ID NO: 199 - DNA, 20 bp, Artificial Sequence
  Description of Artificial Sequence: Synthetic oligonucleotide
ccctgccctcgatttcccgg

SEQ ID NO: 200 - DNA, 20 bp, Artificial Sequence
  Description of Artificial Sequence: Synthetic oligonucleotide
ccggtggtcactctgtatgc

SEQ ID NO: 201 - DNA, 20 bp, Artificial Sequence
  Description of Artificial Sequence: Synthetic oligonucleotide
ggaaatcgagggcagggtca

SEQ ID NO: 202 - DNA, 20 bp, Artificial Sequence
  Description of Artificial Sequence: Synthetic oligonucleotide
ccagcatacagagtgaccac

SEQ ID NO: 203 - DNA, 20 bp, Artificial Sequence
  Description of Artificial Sequence: Synthetic oligonucleotide
cttggcagttgagcacgcgc

SEQ ID NO: 204 - DNA, 20 bp, Artificial Sequence
  Description of Artificial Sequence: Synthetic oligonucleotide
ctgcgcgtgctcaactgcca

SEQ ID NO: 205 - DNA, 20 bp, Artificial Sequence
  Description of Artificial Sequence: Synthetic oligonucleotide
tgcgcgtgctcaactgccaa

SEQ ID NO: 206 - DNA, 20 bp, Artificial Sequence
  Description of Artificial Sequence: Synthetic oligonucleotide
cgggatgccggcgtggccaa

SEQ ID NO: 207 - DNA, 20 bp, Artificial Sequence
  Description of Artificial Sequence: Synthetic oligonucleotide
cgtgctcaactgccaaggga

SEQ ID NO: 208 - DNA, 20 bp, Artificial Sequence
  Description of Artificial Sequence: Synthetic oligonucleotide
ccttggccacgccggcatcc

SEQ ID NO: 209 - DNA, 20 bp, Artificial Sequence
  Description of Artificial Sequence: Synthetic oligonucleotide
cagcggccgggatgccggcg

SEQ ID NO: 210 - DNA, 20 bp, Artificial Sequence
  Description of Artificial Sequence: Synthetic oligonucleotide
ccgggatgccggcgtggcca

SEQ ID NO: 211 - DNA, 20 bp, Artificial Sequence
  Description of Artificial Sequence: Synthetic oligonucleotide
gtggtcagcggccgggatgc

SEQ ID NO: 212 - DNA, 20 bp, Artificial Sequence
  Description of Artificial Sequence: Synthetic oligonucleotide
cgctgaccacccctgccagg

SEQ ID NO: 213 - DNA, 20 bp, Artificial Sequence
  Description of Artificial Sequence: Synthetic oligonucleotide
ggcaggggtggtcagcggcc

SEQ ID NO: 214 - DNA, 20 bp, Artificial Sequence
  Description of Artificial Sequence: Synthetic oligonucleotide
gtgctcaactgccaagggaa

SEQ ID NO: 215 - DNA, 20 bp, Artificial Sequence
  Description of Artificial Sequence: Synthetic oligonucleotide
tcatggcacccacctggcag

SEQ ID NO: 216 - DNA, 20 bp, Artificial Sequence
  Description of Artificial Sequence: Synthetic oligonucleotide
tggcaggggtggtcagcggc

SEQ ID NO: 217 - DNA, 20 bp, Artificial Sequence
  Description of Artificial Sequence: Synthetic oligonucleotide
gctgaccacccctgccaggt

SEQ ID NO: 218 - DNA, 20 bp, Artificial Sequence
  Description of Artificial Sequence: Synthetic oligonucleotide
ggccgctgaccacccctgcc

SEQ ID NO: 219 - DNA, 20 bp, Artificial Sequence
  Description of Artificial Sequence: Synthetic oligonucleotide
ggcatcgtcccggaagttgc

SEQ ID NO: 220 - DNA, 20 bp, Artificial Sequence
  Description of Artificial Sequence: Synthetic oligonucleotide
ggcttttccgaataaactcc

SEQ ID NO: 221 - DNA, 20 bp, Artificial Sequence
  Description of Artificial Sequence: Synthetic oligonucleotide
gtcccggaagttgccggcag

SEQ ID NO: 222 - DNA, 20 bp, Artificial Sequence
  Description of Artificial Sequence: Synthetic oligonucleotide
cggctgtacccacccgccag

SEQ ID NO: 223 - DNA, 20 bp, Artificial Sequence
  Description of Artificial Sequence: Synthetic oligonucleotide
gtcgtgctggtcaccgctgc

SEQ ID NO: 224 - DNA, 20 bp, Artificial Sequence
  Description of Artificial Sequence: Synthetic oligonucleotide
agtagaggcaggcatcgtcc

SEQ ID NO: 225 - DNA, 20 bp, Artificial Sequence
  Description of Artificial Sequence: Synthetic oligonucleotide
tccgaataaactccaggcct

SEQ ID NO: 226 - DNA, 20 bp, Artificial Sequence
  Description of Artificial Sequence: Synthetic oligonucleotide
gtttattcggaaaagccagc

SEQ ID NO: 227 - DNA, 20 bp, Artificial Sequence
  Description of Artificial Sequence: Synthetic oligonucleotide
gcggctgtacccacccgcca

SEQ ID NO: 228 - DNA, 20 bp, Artificial Sequence
  Description of Artificial Sequence: Synthetic oligonucleotide
caccgctgccggcaacttcc

SEQ ID NO: 229 - DNA, 20 bp, Artificial Sequence
  Description of Artificial Sequence: Synthetic oligonucleotide
agccctcgccaggcgctggc

SEQ ID NO: 230 - DNA, 20 bp, Artificial Sequence
  Description of Artificial Sequence: Synthetic oligonucleotide
caacgccgcctgccagcgcc

SEQ ID NO: 231 - DNA, 20 bp, Artificial Sequence
  Description of Artificial Sequence: Synthetic oligonucleotide
gcacgaccccagccctcgcc

SEQ ID NO: 232 - DNA, 20 bp, Artificial Sequence
  Description of Artificial Sequence: Synthetic oligonucleotide
ccgcctgccagcgcctggcg

SEQ ID NO: 233 - DNA, 20 bp, Artificial Sequence
  Description of Artificial Sequence: Synthetic oligonucleotide
tgccagcgcctggcgagggc

SEQ ID NO: 234 - DNA, 20 bp, Artificial Sequence
  Description of Artificial Sequence: Synthetic oligonucleotide
tgctgctgcccctggcgggt

SEQ ID NO: 235 - DNA, 20 bp, Artificial Sequence
  Description of Artificial Sequence: Synthetic oligonucleotide
tcaccgctgccggcaacttc

SEQ ID NO: 236 - DNA, 20 bp, Artificial Sequence
  Description of Artificial Sequence: Synthetic oligonucleotide
ggcgagggctggggtcgtgc

SEQ ID NO: 237 - DNA, 20 bp, Artificial Sequence
  Description of Artificial Sequence: Synthetic oligonucleotide
ttccgaataaactccaggcc

SEQ ID NO: 238 - DNA, 20 bp, Artificial Sequence
  Description of Artificial Sequence: Synthetic oligonucleotide
gtgctgctgcccctggcggg

SEQ ID NO: 239 - DNA, 20 bp, Artificial Sequence
  Description of Artificial Sequence: Synthetic oligonucleotide
gccagcgcctggcgagggct

SEQ ID NO: 240 - DNA, 20 bp, Artificial Sequence
  Description of Artificial Sequence: Synthetic oligonucleotide
cctcgccaggcgctggcagg

SEQ ID NO: 241 - DNA, 20 bp, Artificial Sequence
  Description of Artificial Sequence: Synthetic oligonucleotide
gagatacctgagtaactttc

SEQ ID NO: 242 - DNA, 20 bp, Artificial Sequence
  Description of Artificial Sequence: Synthetic oligonucleotide
acgtgggagaactacaaata

SEQ ID NO: 243 - DNA, 20 bp, Artificial Sequence
  Description of Artificial Sequence: Synthetic oligonucleotide
cgatgttgaattaatgtcca

SEQ ID NO: 244 - DNA, 20 bp, Artificial Sequence
  Description of Artificial Sequence: Synthetic oligonucleotide
cacaaaacttcaatgaaacg

SEQ ID NO: 245 - DNA, 20 bp, Artificial Sequence
  Description of Artificial Sequence: Synthetic oligonucleotide
tacgaattgagttggaagac

SEQ ID NO: 246 - DNA, 20 bp, Artificial Sequence
  Description of Artificial Sequence: Synthetic oligonucleotide
ctatggagtatatcttctct

SEQ ID NO: 247 - DNA, 19 bp, Artificial Sequence
  Description of Artificial Sequence: Synthetic oligonucleotide
ccgcaccttggcgcagcgg

SEQ ID NO: 248 - DNA, 19 bp, Artificial Sequence
  Description of Artificial Sequence: Synthetic oligonucleotide
agatacctgaataaccctc

SEQ ID NO: 249 - DNA, 18 bp, Artificial Sequence
  Description of Artificial Sequence: Synthetic oligonucleotide
gatacctgaataaccctc

SEQ ID NO: 250 - DNA, 17 bp, Artificial Sequence
  Description of Artificial Sequence: Synthetic oligonucleotide
atacctgaataaccctc

SEQ ID NO: 251 - DNA, 20 bp, Artificial Sequence
  Description of Artificial Sequence: Synthetic oligonucleotide
ggctgatgaggccgcacatg

SEQ ID NO: 252 - DNA, 20 bp, Artificial Sequence
  Description of Artificial Sequence: Synthetic oligonucleotide
cgcctgccagcgcctggcga

SEQ ID NO: 253 - RNA, 100 nt, Artificial Sequence
  Description of Artificial Sequence: Synthetic polynucleotide
ggugcuagccuugcguuccgguuuuagagcuagaaauagcaaguuaaaauaaggcuaguccguuaucaacuugaaaaaguggcaccgagucggugcuuuu

SEQ ID NO: 254 - RNA, 100 nt, Artificial Sequence; identical to SEQ ID NO: 253
  Description of Artificial Sequence: Synthetic polynucleotide

SEQ ID NO: 255 - RNA, 101 nt, Artificial Sequence
  Description of Artificial Sequence: Synthetic polynucleotide
ggugcuagccuugcguuccgguuuuagagcuagaaauagcaaguuaaaauaaggcuaguccguuaucaacuugaaaaaguggcaccgagucggugcuuuuu

SEQ ID NO: 256 - RNA, 100 nt, Artificial Sequence; identical to SEQ ID NO: 253
  Description of Artificial Sequence: Synthetic polynucleotide

SEQ ID NO: 257 - RNA, 100 nt, Artificial Sequence
  Description of Artificial Sequence: Synthetic polynucleotide
aagauaccugaauaacucucguuuuagagcuagaaauagcaaguuaaaauaaggcuaguccguuaucaacuugaaaaaguggcaccgagucggugcuuuu

SEQ ID NO: 258 - RNA, 100 nt, Artificial Sequence
  Description of Artificial Sequence: Synthetic polynucleotide
gguggcucaccagcuccagcguuuuagagcuagaaauagcaaguuaaaauaaggcuaguccguuaucaacuugaaaaaguggcaccgagucggugcuuuu

SEQ ID NO: 259 - RNA, 100 nt, Artificial Sequence
  Description of Artificial Sequence: Synthetic polynucleotide
gcuuaccugucuguggaagcguuuuagagcuagaaauagcaaguuaaaauaaggcuaguccguuaucaacuugaaaaaguggcaccgagucggugcuuuu

SEQ ID NO: 260 - RNA, 100 nt, Artificial Sequence
  Description of Artificial Sequence: Synthetic polynucleotide
ugcuuaccugucuguggaagguuuuagagcuagaaauagcaaguuaaaauaaggcuaguccguuaucaacuugaaaaaguggcaccgagucggugcuuuu

SEQ ID NO: 261 - RNA, 100 nt, Artificial Sequence
  Description of Artificial Sequence: Synthetic polynucleotide
uuggaaagacggaggcagccguuuuagagcuagaaauagcaaguuaaaauaaggcuaguccguuaucaacuugaaaaaguggcaccgagucggugcuuuu

SEQ ID NO: 262 - RNA, 100 nt, Artificial Sequence
  Description of Artificial Sequence: Synthetic polynucleotide
gaaagacggaggcagccuggguuuuagagcuagaaauagcaaguuaaaauaaggcuaguccguuaucaacuugaaaaaguggcaccgagucggugcuuuu

SEQ ID NO: 263 - RNA, 100 nt, Artificial Sequence
  Description of Artificial Sequence: Synthetic polynucleotide
ucccaggccuggaguuuauuguuuuagagcuagaaauagcaaguuaaaauaaggcuaguccguuaucaacuugaaaaaguggcaccgagucggugcuuuu

SEQ ID NO: 264 - DNA, 100 bp, Artificial Sequence
  Description of Artificial Sequence: Synthetic oligonucleotide
  Description of Combined DNA/RNA Molecule: Synthetic oligonucleotide
agcaccuaccucgggagctgguuuuagagcuagaaauagcaaguuaaaauaaggcuaguccguuaucaacuugaaaaaguggcaccgagucggugcuuuu

SEQ ID NO: 265 - RNA, 100 nt, Artificial Sequence
  Description of Artificial Sequence: Synthetic polynucleotide
cuuuccaggucaucacaguuguuuuagagcuagaaauagcaaguuaaaauaaggcuaguccguuaucaacuugaaaaaguggcaccgagucggugcuuuu

SEQ ID NO: 266 - RNA, 100 nt, Artificial Sequence
  Description of Artificial Sequence: Synthetic polynucleotide
ccuuuccaggucaucacaguguuuuagagcuagaaauagcaaguuaaaauaaggcuaguccguuaucaacuugaaaaaguggcaccgagucggugcuuuu

SEQ ID NO: 267 - RNA, 100 nt, Artificial Sequence
  Description of Artificial Sequence: Synthetic polynucleotide
uuuccaggucaucacaguugguuuuagagcuagaaauagcaaguuaaaauaaggcuaguccguuaucaacuugaaaaaguggcaccgagucggugcuuuu

SEQ ID NO: 268 - RNA, 100 nt, Artificial Sequence
  Description of Artificial Sequence: Synthetic polynucleotide
cuuaccugccccaugggugcguuuuagagcuagaaauagcaaguuaaaauaaggcuaguccguuaucaacuugaaaaaguggcaccgagucggugcuuuu

SEQ ID NO: 269 - RNA, 100 nt, Artificial Sequence
  Description of Artificial Sequence: Synthetic polynucleotide
uaaggcccaagggggcaagcguuuuagagcuagaaauagcaaguuaaaauaaggcuaguccguuaucaacuugaaaaaguggcaccgagucggugcuuuu

SEQ ID NO: 270 - RNA, 100 nt, Artificial Sequence
  Description of Artificial Sequence: Synthetic polynucleotide
ccucuucaccugcuccugagguuuuagagcuagaaauagcaaguuaaaauaaggcuaguccguuaucaacuugaaaaaguggcaccgagucggugcuuuu

SEQ ID NO: 271 - RNA, 100 nt, Artificial Sequence
  Description of Artificial Sequence: Synthetic polynucleotide
gccucuucaccugcuccugaguuuuagagcuagaaauagcaaguuaaaauaaggcuaguccguuaucaacuugaaaaaguggcaccgagucggugcuuuu

SEQ ID NO: 272 - RNA, 100 nt, Artificial Sequence
  Description of Artificial Sequence: Synthetic polynucleotide
uucaccugcuccugaggggcguuuuagagcuagaaauagcaaguuaaaauaaggcuaguccguuaucaacuugaaaaaguggcaccgagucggugcuuuu

SEQ ID NO: 273 - RNA, 100 nt, Artificial Sequence
  Description of Artificial Sequence: Synthetic polynucleotide
ucaccugcuccugaggggccguuuuagagcuagaaauagcaaguuaaaauaaggcuaguccguuaucaacuugaaaaaguggcaccgagucggugcuuuu

SEQ ID NO: 274 - RNA, 100 nt, Artificial Sequence
  Description of Artificial Sequence: Synthetic polynucleotide
cccaggcugcagcucccacuguuuuagagcuagaaauagcaaguuaaaauaaggcuaguccguuaucaacuugaaaaaguggcaccgagucggugcuuuu

SEQ ID NO: 275 - RNA, 100 nt, Artificial Sequence
  Description of Artificial Sequence: Synthetic polynucleotide
ccccaggcugcagcucccacguuuuagagcuagaaauagcaaguuaaaauaaggcuaguccguuaucaacuugaaaaaguggcaccgagucggugcuuuu

SEQ ID NO: 276 - RNA, 100 nt, Artificial Sequence
  Description of Artificial Sequence: Synthetic polynucleotide
gcaggugaccguggccugcgguuuuagagcuagaaauagcaaguuaaaauaaggcuaguccguuaucaacuugaaaaaguggcaccgagucggugcuuuu

SEQ ID NO: 277 - RNA, 100 nt, Artificial Sequence
  Description of Artificial Sequence: Synthetic polynucleotide
cuccuuuaggaggcugguggguuuuagagcuagaaauagcaaguuaaaauaaggcuaguccguuaucaacuugaaaaaguggcaccgagucggugcuuuu

SEQ ID NO: 278 - RNA, 100 nt, Artificial Sequence
  Description of Artificial Sequence: Synthetic polynucleotide
uuuucaggagaauuuugguuguuuuagagcuagaaauagcaaguuaaaauaaggcuaguccguuaucaacuugaaaaaguggcaccgagucggugcuuuu

SEQ ID NO: 279 - RNA, 100 nt, Artificial Sequence
  Description of Artificial Sequence: Synthetic polynucleotide
cuuuucaggagaauuuugguguuuuagagcuagaaauagcaaguuaaaauaaggcuaguccguuaucaacuugaaaaaguggcaccgagucggugcuuuu

SEQ ID NO: 280 - RNA, 100 nt, Artificial Sequence
  Description of Artificial Sequence: Synthetic polynucleotide
uaauuuggcccuucgucuuaguuuuagagcuagaaauagcaaguuaaaauaaggcuaguccguuaucaacuugaaaaaguggcaccgagucggugcuuuu

SEQ ID NO: 281 - RNA, 100 nt, Artificial Sequence
  Description of Artificial Sequence: Synthetic polynucleotide
agacuuuguccauaagacgaguuuuagagcuagaaauagcaaguuaaaauaaggcuaguccguuaucaacuugaaaaaguggcaccgagucggugcuuuu

SEQ ID NO: 282 - RNA, 100 nt, Artificial Sequence
  Description of Artificial Sequence: Synthetic polynucleotide
gacuuuguccauaagacgaaguuuuagagcuagaaauagcaaguuaaaauaaggcuaguccguuaucaacuugaaaaaguggcaccgagucggugcuuuu

SEQ ID NO: 283 - RNA, 100 nt, Artificial Sequence
  Description of Artificial Sequence: Synthetic polynucleotide
agccaauggccuccuucaguguuuuagagcuagaaauagcaaguuaaaauaaggcuaguccguuaucaacuugaaaaaguggcaccgagucggugcuuuu

SEQ ID NO: 284 - RNA, 100 nt, Artificial Sequence
  Description of Artificial Sequence: Synthetic polynucleotide
ucccaacugaaggaggccauguuuuagagcuagaaauagcaaguuaaaauaaggcuaguccguuaucaacuugaaaaaguggcaccgagucggugcuuuu

SEQ ID NO: 285 - RNA, 100 nt, Artificial Sequence
  Description of Artificial Sequence: Synthetic polynucleotide
ggccuccuucaguugggacaguuuuagagcuagaaauagcaaguuaaaauaaggcuaguccguuaucaacuugaaaaaguggcaccgagucggugcuuuu

SEQ ID NO: 286 - RNA, 100 nt, Artificial Sequence
  Description of Artificial Sequence: Synthetic polynucleotide
gaccaugucccaacugaaggguuuuagagcuagaaauagcaaguuaaaauaaggcuaguccguuaucaacuugaaaaaguggcaccgagucggugcuuuu

SEQ ID NO: 287 - RNA, 100 nt, Artificial Sequence
  Description of Artificial Sequence: Synthetic polynucleotide
gccaauggccuccuucaguuguuuuagagcuagaaauagcaaguuaaaauaaggcuaguccguuaucaacuugaaaaaguggcaccgagucggugcuuuu

SEQ ID NO: 288 - RNA, 100 nt, Artificial Sequence
  Description of Artificial Sequence: Synthetic polynucleotide
auugucuugaucaauucuggguuuuagagcuagaaauagcaaguuaaaauaaggcuaguccguuaucaacuugaaaaaguggcaccgagucggugcuuuu

SEQ ID NO: 289 - RNA, 100 nt, Artificial Sequence
  Description of Artificial Sequence: Synthetic polynucleotide
auucuggaggaaauaacuagguuuuagagcuagaaauagcaaguuaaaauaaggcuaguccguuaucaacuugaaaaaguggcaccgagucggugcuuuu

SEQ ID NO: 290 - RNA, 100 nt, Artificial Sequence
  Description of Artificial Sequence: Synthetic polynucleotide
ucuggguguucuggaguuucguuuuagagcuagaaauagcaaguuaaaauaaggcuaguccguuaucaacuugaaaaaguggcaccgagucggugcuuuu

SEQ ID NO: 291 - RNA, 100 nt, Artificial Sequence
  Description of Artificial Sequence: Synthetic polynucleotide
aacauagcaaaucuugauuuguuuuagagcuagaaauagcaaguuaaaauaaggcuaguccguuaucaacuugaaaaaguggcaccgagucggugcuuuu

SEQ ID NO: 292 - RNA, 100 nt, Artificial Sequence
  Description of Artificial Sequence: Synthetic polynucleotide
guagaauuuuuucuucuaggguuuuagagcuagaaauagcaaguuaaaauaaggcuaguccguuaucaacuugaaaaaguggcaccgagucggugcuuuu

SEQ ID NO: 293 - RNA, 100 nt, Artificial Sequence
  Description of Artificial Sequence: Synthetic polynucleotide
acuacaagucaaaaaugaagguuuuagagcuagaaauagcaaguuaaaauaaggcuaguccguuaucaacuugaaaaaguggcaccgagucggugcuuuu

SEQ ID NO: 294 - RNA, 100 nt, Artificial Sequence
  Description of Artificial Sequence: Synthetic polynucleotide
uauauuggucuuccacggucguuuuagagcuagaaauagcaaguuaaaauaaggcuaguccguuaucaacuugaaaaaguggcaccgagucggugcuuuu

SEQ ID NO: 295 - RNA, 100 nt, Artificial Sequence
  Description of Artificial Sequence: Synthetic polynucleotide
caaagaccuucuccagaccgguuuuagagcuagaaauagcaaguuaaaauaaggcuaguccguuaucaacuugaaaaaguggcaccgagucggugcuuuu

SEQ ID NO: 296 - RNA, 100 nt, Artificial Sequence
  Description of Artificial Sequence: Synthetic polynucleotide
ggucuuccacggucuggagaguuuuagagcuagaaauagcaaguuaaaauaaggcuaguccguuaucaacuugaaaaaguggcaccgagucggugcuuuu

SEQ ID NO: 297 - RNA, 100 nt, Artificial Sequence
  Description of Artificial Sequence: Synthetic polynucleotide
uuguuuauauuggucuuccaguuuuagagcuagaaauagcaaguuaaaauaaggcuaguccguuaucaacuugaaaaaguggcaccgagucggugcuuuu

SEQ ID NO: 298 - RNA, 100 nt, Artificial Sequence
  Description of Artificial Sequence: Synthetic polynucleotide
cuuuuauuugacuaugcuguguuuuagagcuagaaauagcaaguuaaaauaaggcuaguccguuaucaacuugaaaaaguggcaccgagucggugcuuuu

SEQ ID NO: 299 - RNA, 100 nt, Artificial Sequence
  Description of Artificial Sequence: Synthetic polynucleotide
aaagucuggauauagagaguguuuuagagcuagaaauagcaaguuaaaauaaggcuaguccguuaucaacuugaaaaaguggcaccgagucggugcuuuu

SEQ ID NO: 300 - RNA, 100 nt, Artificial Sequence
  Description of Artificial Sequence: Synthetic polynucleotide
guugguuuaauuguuuauauguuuuagagcuagaaauagcaaguuaaaauaaggcuaguccguuaucaacuugaaaaaguggcaccgagucggugcuuuu

SEQ ID NO: 301 - RNA, 100 nt, Artificial Sequence
  Description of Artificial Sequence: Synthetic polynucleotide
ugaugguaagacacuuugguguuuuagagcuagaaauagcaaguuaaaauaaggcuaguccguuaucaacuugaaaaaguggcaccgagucggugcuuuu

SEQ ID NO: 302 - RNA, 100 nt, Artificial Sequence
  Description of Artificial Sequence: Synthetic polynucleotide
ggaguaguucuuggugcucuguuuuagagcuagaaauagcaaguuaaaauaaggcuaguccguuaucaacuugaaaaaguggcaccgagucggugcuuuu

SEQ ID NO: 303 - RNA, 100 nt, Artificial Sequence
  Description of Artificial Sequence: Synthetic polynucleotide
aacaugaugguaagacacuuguuuuagagcuagaaauagcaaguuaaaauaaggcuaguccguuaucaacuugaaaaaguggcaccgagucggugcuuuu

SEQ ID NO: 304 - RNA, 100 nt, Artificial Sequence
  Description of Artificial Sequence: Synthetic polynucleotide
ugaagaaagggaguaguucuguuuuagagcuagaaauagcaaguuaaaauaaggcuaguccguuaucaacuugaaaaaguggcaccgagucggugcuuuu

SEQ ID NO: 305 - RNA, 100 nt, Artificial Sequence
  Description of Artificial Sequence: Synthetic polynucleotide
aguucuuggugcucuuggcuguuuuagagcuagaaauagcaaguuaaaauaaggcuaguccguuaucaacuugaaaaaguggcaccgagucggugcuuuu

SEQ ID NO: 306 - RNA, 100 nt, Artificial Sequence
  Description of Artificial Sequence: Synthetic polynucleotide
augaugguaagacacuuuggguuuuagagcuagaaauagcaaguuaaaauaaggcuaguccguuaucaacuugaaaaaguggcaccgagucggugcuuuu

SEQ ID NO: 307 - RNA, 100 nt, Artificial Sequence
  Description of Artificial Sequence: Synthetic polynucleotide
gaagauagagaaauuucuguguuuuagagcuagaaauagcaaguuaaaauaaggcuaguccguuaucaacuugaaaaaguggcaccgagucggugcuuuu

SEQ ID NO: 308 - RNA, 100 nt, Artificial Sequence
  Description of Artificial Sequence: Synthetic polynucleotide
ggaagauagagaaauuucugguuuuagagcuagaaauagcaaguuaaaauaaggcuaguccguuaucaacuugaaaaaguggcaccgagucggugcuuuu

SEQ ID NO: 309 - RNA, 100 nt, Artificial Sequence
  Description of Artificial Sequence: Synthetic polynucleotide
uauuucauucaacugaagaaguuuuagagcuagaaauagcaaguuaaaauaaggcuaguccguuaucaacuugaaaaaguggcaccgagucggugcuuuu

SEQ ID NO: 310 - RNA, 100 nt, Artificial Sequence
  Description of Artificial Sequence: Synthetic polynucleotide
auuucauucaacugaagaaaguuuuagagcuagaaauagcaaguuaaaauaaggcuaguccguuaucaacuugaaaaaguggcaccgagucggugcuuuu

SEQ ID NO: 311 - RNA, 100 nt, Artificial Sequence
  Description of Artificial Sequence: Synthetic polynucleotide
gucuacugugauguuauaucguuuuagagcuagaaauagcaaguuaaaauaaggcuaguccguuaucaacuugaaaaaguggcaccgagucggugcuuuu

SEQ ID NO: 312 - RNA, 100 nt, Artificial Sequence
  Description of Artificial Sequence: Synthetic polynucleotide
uaaauggugguacauucagcguuuuagagcuagaaauagcaaguuaaaauaaggcuaguccguuaucaacuugaaaaaguggcaccgagucggugcuuuu

SEQ ID NO: 313 - RNA, 100 nt, Artificial Sequence
  Description of Artificial Sequence: Synthetic polynucleotide
uaucagguaaaaccugucuaguuuuagagcuagaaauagcaaguuaaaauaaggcuaguccguuaucaacuugaaaaaguggcaccgagucggugcuuuu

SEQ ID NO: 314 - RNA, 100 nt, Artificial Sequence
  Description of Artificial Sequence: Synthetic polynucleotide
uguaccaccauuuauaacagguuuuagagcuagaaauagcaaguuaaaauaaggcuaguccguuaucaacuugaaaaaguggcaccgagucggugcuuuu

SEQ ID NO: 315 - RNA, 100 nt, Artificial Sequence
  Description of Artificial Sequence: Synthetic polynucleotide
uucaccucuguuauaaauggguuuuagagcuagaaauagcaaguuaaaauaaggcuaguccguuaucaacuugaaaaaguggcaccgagucggugcuuuu

SEQ ID NO: 316 - RNA, 100 nt, Artificial Sequence
  Description of Artificial Sequence: Synthetic polynucleotide
aacagaggugaacauacaagguuuuagagcuagaaauagcaaguuaaaauaaggcuaguccguuaucaacuugaaaaaguggcaccgagucggugcuuuu

SEQ ID NO: 317 - RNA, 100 nt, Artificial Sequence
  Description of Artificial Sequence: Synthetic polynucleotide
uugagaguugcugggucugaguuuuagagcuagaaauagcaaguuaaaauaaggcuaguccguuaucaacuugaaaaaguggcaccgagucggugcuuuu

SEQ ID NO: 318 - RNA, 100 nt, Artificial Sequence
  Description of Artificial Sequence: Synthetic polynucleotide
ugaaaaacuugagaguugcuguuuuagagcuagaaauagcaaguuaaaauaaggcuaguccguuaucaacuugaaaaaguggcaccgagucggugcuuuu

SEQ ID NO: 319 - RNA, 100 nt, Artificial Sequence
  Description of Artificial Sequence: Synthetic polynucleotide
uuaauucaacaucgaauagaguuuuagagcuagaaauagcaaguuaaaauaaggcuaguccguuaucaacuugaaaaaguggcaccgagucggugcuuuu

SEQ ID NO: 320 - RNA, 100 nt, Artificial Sequence
  Description of Artificial Sequence: Synthetic polynucleotide
uuugggaggcuugaugguaaguuuuagagcuagaaauagcaaguuaaaauaaggcuaguccguuaucaacuugaaaaaguggcaccgagucggugcuuuu

SEQ ID NO: 321 - RNA, 100 nt, Artificial Sequence
  Description of Artificial Sequence: Synthetic polynucleotide
cauuauauucagguaguccaguuuuagagcuagaaauagcaaguuaaaauaaggcuaguccguuaucaacuugaaaaaguggcaccgagucggugcuuuu

SEQ ID NO: 322 - RNA, 100 nt, Artificial Sequence
  Description of Artificial Sequence: Synthetic polynucleotide
uugggaggcuugaugguaagguuuuagagcuagaaauagcaaguuaaaauaaggcuaguccguuaucaacuugaaaaaguggcaccgagucggugcuuuu

SEQ ID NO: 323 - RNA, 100 nt, Artificial Sequence
  Description of Artificial Sequence: Synthetic polynucleotide
uuuugggaggcuugaugguaguuuuagagcuagaaauagcaaguuaaaauaaggcuaguccguuaucaacuugaaaaaguggcaccgagucggugcuuuu

SEQ ID NO: 324 - RNA, 100 nt, Artificial Sequence
  Description of Artificial Sequence: Synthetic polynucleotide
acaaaacuucaaugaaacguguuuuagagcuagaaauagcaaguuaaaauaaggcuaguccguuaucaacuugaaaaaguggcaccgagucggugcuuuu

SEQ ID NO: 325 - RNA, 100 nt, Artificial Sequence
  Description of Artificial Sequence: Synthetic polynucleotide
uaugguuuugggaggcuugaguuuuagagcuagaaauagcaaguuaaaauaaggcuaguccguuaucaacuugaaaaaguggcaccgagucggugcuuuu

SEQ ID NO: 326 - RNA, 100 nt, Artificial Sequence
  Description of Artificial Sequence: Synthetic polynucleotide
acuacaaauaugguuuugggguuuuagagcuagaaauagcaaguuaaaauaaggcuaguccguuaucaacuugaaaaaguggcaccgagucggugcuuuu

SEQ ID NO: 327 - RNA, 100 nt, Artificial Sequence
  Description of Artificial Sequence: Synthetic polynucleotide
gagaacuacaaauaugguuuguuuuagagcuagaaauagcaaguuaaaauaaggcuaguccguuaucaacuugaaaaaguggcaccgagucggugcuuuu

SEQ ID NO: 328 - RNA, 100 nt, Artificial Sequence
  Description of Artificial Sequence: Synthetic polynucleotide
aggacacuucaacuguccagguuuuagagcuagaaauagcaaguuaaaauaaggcuaguccguuaucaacuugaaaaaguggcaccgagucggugcuuuu

SEQ ID NO: 329 - RNA, 100 nt, Artificial Sequence
  Description of Artificial Sequence: Synthetic polynucleotide
gccguccuccucggaacgcaguuuuagagcuagaaauagcaaguuaaaauaaggcuaguccguuaucaacuugaaaaaguggcaccgagucggugcuuuu

SEQ ID NO: 330 - RNA, 100 nt, Artificial Sequence
  Description of Artificial Sequence: Synthetic polynucleotide
gcuagccuugcguuccgaggguuuuagagcuagaaauagcaaguuaaaauaaggcuaguccguuaucaacuugaaaaaguggcaccgagucggugcuuuu

SEQ ID NO: 331 - RNA, 100 nt, Artificial Sequence
  Description of Artificial Sequence: Synthetic polynucleotide
gcguuccgaggaggacggccguuuuagagcuagaaauagcaaguuaaaauaaggcuaguccguuaucaacuugaaaaaguggcaccgagucggugcuuuu

SEQ ID NO: 332 - RNA, 100 nt, Artificial Sequence
  Description of Artificial Sequence: Synthetic polynucleotide
gccuugcguuccgaggaggaguuuuagagcuagaaauagcaaguuaaaauaaggcuaguccguuaucaacuugaaaaaguggcaccgagucggugcuuuu

SEQ ID NO: 333 - RNA, 100 nt, Artificial Sequence
  Description of Artificial Sequence: Synthetic polynucleotide
ggacgaggacggcgacuacgguuuuagagcuagaaauagcaaguuaaaauaaggcuaguccguuaucaacuugaaaaaguggcaccgagucggugcuuuu

SEQ ID NO: 334 - RNA, 100 nt, Artificial Sequence
  Description of Artificial Sequence: Synthetic polynucleotide
ggacggcgacuacgaggagcguuuuagagcuagaaauagcaaguuaaaauaaggcuaguccguuaucaacuugaaaaaguggcaccgagucggugcuuuu

SEQ ID NO: 335 - RNA, 100 nt, Artificial Sequence
  Description of Artificial Sequence: Synthetic polynucleotide
cguccucguccuccugcgcaguuuuagagcuagaaauagcaaguuaaaauaaggcuaguccguuaucaacuugaaaaaguggcaccgagucggugcuuuu

SEQ ID NO: 336 - RNA, 100 nt, Artificial Sequence
  Description of Artificial Sequence: Synthetic polynucleotide
guccucguccuccugcgcacguuuuagagcuagaaauagcaaguuaaaauaaggcuaguccguuaucaacuugaaaaaguggcaccgagucggugcuuuu

SEQ ID NO: 337 - RNA, 100 nt, Artificial Sequence
  Description of Artificial Sequence: Synthetic polynucleotide
ccgucagcuccaggcgguccguuuuagagcuagaaauagcaaguuaaaauaaggcuaguccguuaucaacuugaaaaaguggcaccgagucggugcuuuu

SEQ ID NO: 338 - RNA, 100 nt, Artificial Sequence
  Description of Artificial Sequence: Synthetic polynucleotide
cgcccgugcgcaggaggacgguuuuagagcuagaaauagcaaguuaaaauaaggcuaguccguuaucaacuugaaaaaguggcaccgagucggugcuuuu

SEQ ID NO: 339 - RNA, 100 nt, Artificial Sequence
  Description of Artificial Sequence: Synthetic polynucleotide
ucagcuccaggcgguccuggguuuuagagcuagaaauagcaaguuaaaauaaggcuaguccguuaucaacuugaaaaaguggcaccgagucggugcuuuu

SEQ ID NO: 340 - RNA, 100 nt, Artificial Sequence
  Description of Artificial Sequence: Synthetic polynucleotide
cuuggcgcagcgguggaaggguuuuagagcuagaaauagcaaguuaaaauaaggcuaguccguuaucaacuugaaaaaguggcaccgagucggugcuuuu

SEQ ID NO: 341 - RNA, 100 nt, Artificial Sequence
  Description of Artificial Sequence: Synthetic polynucleotide
cgugcgcaggaggacgaggaguuuuagagcuagaaauagcaaguuaaaauaaggcuaguccguuaucaacuugaaaaaguggcaccgagucggugcuuuu

SEQ ID NO: 342 - RNA, 100 nt, Artificial Sequence
  Description of Artificial Sequence: Synthetic polynucleotide
ccaggaccgccuggagcugaguuuuagagcuagaaauagcaaguuaaaauaaggcuaguccguuaucaacuugaaaaaguggcaccgagucggugcuuuu

SEQ ID NO: 343 - RNA, 100 nt, Artificial Sequence
  Description of Artificial Sequence: Synthetic polynucleotide
ucuuggugagguauccccggguuuuagagcuagaaauagcaaguuaaaauaaggcuaguccguuaucaacuugaaaaaguggcaccgagucggugcuuuu

SEQ ID NO: 344 - RNA, 100 nt, Artificial Sequence
  Description of Artificial Sequence: Synthetic polynucleotide
cagugcgcucugacugcgagguuuuagagcuagaaauagcaaguuaaaauaaggcuaguccguuaucaacuugaaaaaguggcaccgagucggugcuuuu

SEQ ID NO: 345 - RNA, 100 nt, Artificial Sequence
  Description of Artificial Sequence: Synthetic polynucleotide
cuuggugagguauccccggcguuuuagagcuagaaauagcaaguuaaaauaaggcuaguccguuaucaacuugaaaaaguggcaccgagucggugcuuuu

SEQ ID NO: 346 - RNA, 100 nt, Artificial Sequence
  Description of Artificial Sequence: Synthetic polynucleotide
ggaucuuggugagguaucccguuuuagagcuagaaauagcaaguuaaaauaaggcuaguccguuaucaacuugaaaaaguggcaccgagucggugcuuuu

SEQ ID NO: 347 - RNA, 100 nt, Artificial Sequence
  Description of Artificial Sequence: Synthetic polynucleotide
gaagaugaguggcgaccugcguuuuagagcuagaaauagcaaguuaaaauaaggcuaguccguuaucaacuugaaaaaguggcaccgagucggugcuuuu

SEQ ID NO: 348 - RNA, 100 nt, Artificial Sequence
  Description of Artificial Sequence: Synthetic polynucleotide
agcaccaccacguaggugccguuuuagagcuagaaauagcaaguuaaaauaaggcuaguccguuaucaacuugaaaaaguggcaccgagucggugcuuuu

SEQ ID NO: 349 - RNA, 100 nt, Artificial Sequence
  Description of Artificial Sequence: Synthetic polynucleotide
ggucgccacucaucuucaccguuuuagagcuagaaauagcaaguuaaaauaaggcuaguccguuaucaacuugaaaaaguggcaccgagucggugcuuuu

SEQ ID NO: 350 - RNA, 100 nt, Artificial Sequence
  Description of Artificial Sequence: Synthetic polynucleotide
cuccuucagcaccaccacguguuuuagagcuagaaauagcaaguuaaaauaaggcuaguccguuaucaacuugaaaaaguggcaccgagucggugcuuuu

SEQ ID NO: 351 - RNA, 100 nt, Artificial Sequence
  Description of Artificial Sequence: Synthetic polynucleotide
gaguggcgaccugcuggagcguuuuagagcuagaaauagcaaguuaaaauaaggcuaguccguuaucaacuugaaaaaguggcaccgagucggugcuuuu

SEQ ID NO: 352 - RNA, 100 nt, Artificial Sequence
  Description of Artificial Sequence: Synthetic polynucleotide
gcgcacugcccgccgccugcguuuuagagcuagaaauagcaaguuaaaauaaggcuaguccguuaucaacuugaaaaaguggcaccgagucggugcuuuu

SEQ ID NO: 353 - RNA, 100 nt, Artificial Sequence
  Description of Artificial Sequence: Synthetic polynucleotide
ggcuuccuggugaagaugagguuuuagagcuagaaauagcaaguuaaaauaaggcuaguccguuaucaacuugaaaaaguggcaccgagucggugcuuuu

SEQ ID NO: 354 - RNA, 100 nt, Artificial Sequence
  Description of Artificial Sequence: Synthetic polynucleotide
caccuacgugguggugcugaguuuuagagcuagaaauagcaaguuaaaauaaggcuaguccguuaucaacuugaaaaaguggcaccgagucggugcuuuu

SEQ ID NO: 355 - RNA, 100 nt, Artificial Sequence
  Description of Artificial Sequence: Synthetic polynucleotide
cuacgugguggugcugaaggguuuuagagcuagaaauagcaaguuaaaauaaggcuaguccguuaucaacuugaaaaaguggcaccgagucggugcuuuu

SEQ ID NO: 356 - RNA, 100 nt, Artificial Sequence
  Description of Artificial Sequence: Synthetic polynucleotide
auggaagacaugcaggaucuguuuuagagcuagaaauagcaaguuaaaauaaggcuaguccguuaucaacuugaaaaaguggcaccgagucggugcuuuu

SEQ ID NO: 357 - RNA, 100 nt, Artificial Sequence
  Description of Artificial Sequence: Synthetic polynucleotide
agacaugcaggaucuuggugguuuuagagcuagaaauagcaaguuaaaauaaggcuaguccguuaucaacuugaaaaaguggcaccgagucggugcuuuu

SEQ ID NO: 358 - RNA, 100 nt, Artificial Sequence
  Description of Artificial Sequence: Synthetic polynucleotide
cucaucuucaccaggaagccguuuuagagcuagaaauagcaaguuaaaauaaggcuaguccguuaucaacuugaaaaaguggcaccgagucggugcuuuu

SEQ ID NO: 359 - RNA, 100 nt, Artificial Sequence
  Description of Artificial Sequence: Synthetic polynucleotide
cuccucgauguagucgacauguuuuagagcuagaaauagcaaguuaaaauaaggcuaguccguuaucaacuugaaaaaguggcaccgagucggugcuuuu

SEQ ID NO: 360 - RNA, 100 nt, Artificial Sequence
  Description of Artificial Sequence: Synthetic polynucleotide
uauucauccgcccgguaccgguuuuagagcuagaaauagcaaguuaaaauaaggcuaguccguuaucaacuugaaaaaguggcaccgagucggugcuuuu

SEQ ID NO: 361 - RNA, 100 nt, Artificial Sequence
  Description of Artificial Sequence: Synthetic polynucleotide
uccucgauguagucgacaugguuuuagagcuagaaauagcaaguuaaaauaaggcuaguccguuaucaacuugaaaaaguggcaccgagucggugcuuuu

SEQ ID NO: 362 - RNA, 100 nt, Artificial Sequence
  Description of Artificial Sequence: Synthetic polynucleotide
ccuccucgauguagucgacaguuuuagagcuagaaauagcaaguuaaaauaaggcuaguccguuaucaacuugaaaaaguggcaccgagucggugcuuuu

SEQ ID NO: 363 - RNA, 100 nt, Artificial Sequence
  Description of Artificial Sequence: Synthetic polynucleotide
gccccaugucgacuacaucgguuuuagagcuagaaauagcaaguuaaaauaaggcuaguccguuaucaacuugaaaaaguggcaccgagucggugcuuuu

SEQ ID NO: 364 - RNA, 100 nt, Artificial Sequence
  Description of Artificial Sequence: Synthetic polynucleotide
ccaugucgacuacaucgaggguuuuagagcuagaaauagcaaguuaaaauaaggcuaguccguuaucaacuugaaaaaguggcaccgagucggugcuuuu

SEQ ID NO: 365 - RNA, 100 nt, Artificial Sequence
  Description of Artificial Sequence: Synthetic polynucleotide
ggggcugguauucauccgccguuuuagagcuagaaauagcaaguuaaaauaaggcuaguccguuaucaacuugaaaaaguggcaccgagucggugcuuuu

SEQ ID NO: 366 - RNA, 100 nt, Artificial Sequence
  Description of Artificial Sequence: Synthetic polynucleotide
gucgacauggggcaacuucaguuuuagagcuagaaauagcaaguuaaaauaaggcuaguccguuaucaacuugaaaaaguggcaccgagucggugcuuuu

SEQ ID NO: 367 - RNA, 100 nt, Artificial Sequence
  Description of Artificial Sequence: Synthetic polynucleotide
accaccgggaaaucgagggcguuuuagagcuagaaauagcaaguuaaaauaaggcuaguccguuaucaacuugaaaaaguggcaccgagucggugcuuuu

SEQ ID NO: 368 - RNA, 100 nt, Artificial Sequence
  Description of Artificial Sequence: Synthetic polynucleotide
gagugaccaccgggaaaucgguuuuagagcuagaaauagcaaguuaaaauaaggcuaguccguuaucaacuugaaaaaguggcaccgagucggugcuuuu

SEQ ID NO: 369 - RNA, 100 nt, Artificial Sequence
  Description of Artificial Sequence: Synthetic polynucleotide
agugaccaccgggaaaucgaguuuuagagcuagaaauagcaaguuaaaauaaggcuaguccguuaucaacuugaaaaaguggcaccgagucggugcuuuu

SEQ ID NO: 370 - RNA, 100 nt, Artificial Sequence
  Description of Artificial Sequence: Synthetic polynucleotide
ccaccgggaaaucgagggcaguuuuagagcuagaaauagcaaguuaaaauaaggcuaguccguuaucaacuugaaaaaguggcaccgagucggugcuuuu

SEQ ID NO: 371 - RNA, 100 nt, Artificial Sequence
  Description of Artificial Sequence: Synthetic polynucleotide
gaagcgggucccguccuccuguuuuagagcuagaaauagcaaguuaaaauaaggcuaguccguuaucaacuugaaaaaguggcaccgagucggugcuuuu

SEQ ID NO: 372 - RNA, 100 nt, Artificial Sequence
  Description of Artificial Sequence: Synthetic polynucleotide
cuaggagauacaccuccaccguuuuagagcuagaaauagcaaguuaaaauaaggcuaguccguuaucaacuugaaaaaguggcaccgagucggugcuuuu

SEQ ID NO: 373 - RNA, 100 nt, Artificial Sequence
  Description of Artificial Sequence: Synthetic polynucleotide
cagcauacagagugaccaccguuuuagagcuagaaauagcaaguuaaaauaaggcuaguccguuaucaacuugaaaaaguggcaccgagucggugcuuuu

SEQ ID NO: 374 - RNA, 100 nt, Artificial Sequence
  Description of Artificial Sequence: Synthetic polynucleotide
aagcgggucccguccuccucguuuuagagcuagaaauagcaaguuaaaauaaggcuaguccguuaucaacuugaaaaaguggcaccgagucggugcuuuu

SEQ ID NO: 375 - RNA, 100 nt, Artificial Sequence
  Description of Artificial Sequence: Synthetic polynucleotide
ugacccugcccucgauuuccguuuuagagcuagaaauagcaaguuaaaauaaggcuaguccguuaucaacuugaaaaaguggcaccgagucggugcuuuu

SEQ ID NO: 376 - RNA, 100 nt, Artificial Sequence
  Description of Artificial Sequence: Synthetic polynucleotide
cacucuguaugcuggugucuguuuuagagcuagaaauagcaaguuaaaauaaggcuaguccguuaucaacuugaaaaaguggcaccgagucggugcuuuu

SEQ ID NO: 377 - RNA, 100 nt, Artificial Sequence
  Description of Artificial Sequence: Synthetic polynucleotide
cccugcccucgauuucccggguuuuagagcuagaaauagcaaguuaaaauaaggcuaguccguuaucaacuugaaaaaguggcaccgagucggugcuuuu

SEQ ID NO: 378 - RNA, 100 nt, Artificial Sequence
  Description of Artificial Sequence: Synthetic polynucleotide
ccgguggucacucuguaugcguuuuagagcuagaaauagcaaguuaaaauaaggcuaguccguuaucaacuugaaaaaguggcaccgagucggugcuuuu

SEQ ID NO: 379 - RNA, 100 nt, Artificial Sequence
  Description of Artificial Sequence: Synthetic polynucleotide
ggaaaucgagggcagggucaguuuuagagcuagaaauagcaaguuaaaauaaggcuaguccguuaucaacuugaaaaaguggcaccgagucggugcuuuu

SEQ ID NO: 380 - RNA, 100 nt, Artificial Sequence
  Description of Artificial Sequence: Synthetic polynucleotide
ccagcauacagagugaccacguuuuagagcuagaaauagcaaguuaaaauaaggcuaguccguuaucaacuugaaaaaguggcaccgagucggugcuuuu

SEQ ID NO: 381 - RNA, 100 nt, Artificial Sequence
  Description of Artificial Sequence: Synthetic polynucleotide
cuuggcaguugagcacgcgcguuuuagagcuagaaauagcaaguuaaaauaaggcuaguccguuaucaacuugaaaaaguggcaccgagucggugcuuuu

SEQ ID NO: 382 - RNA, 100 nt, Artificial Sequence
  Description of Artificial Sequence: Synthetic polynucleotide
cugcgcgugcucaacugccaguuuuagagcuagaaauagcaaguuaaaauaaggcuaguccguuaucaacuugaaaaaguggcaccgagucggugcuuuu

SEQ ID NO: 383 - RNA, 100 nt, Artificial Sequence
  Description of Artificial Sequence: Synthetic polynucleotide
ugcgcgugcucaacugccaaguuuuagagcuagaaauagcaaguuaaaauaaggcuaguccguuaucaacuugaaaaaguggcaccgagucggugcuuuu

SEQ ID NO: 384 - RNA, 100 nt, Artificial Sequence
  Description of Artificial Sequence: Synthetic polynucleotide
cgggaugccggcguggccaaguuuuagagcuagaaauagcaaguuaaaauaaggcuaguccguuaucaacuugaaaaaguggcaccgagucggugcuuuu

SEQ ID NO: 385 - RNA, 100 nt, Artificial Sequence
  Description of Artificial Sequence: Synthetic polynucleotide
cgugcucaacugccaagggaguuuuagagcuagaaauagcaaguuaaaauaaggcuaguccguuaucaacuugaaaaaguggcaccgagucggugcuuuu

SEQ ID NO: 386 - RNA, 100 nt, Artificial Sequence
  Description of Artificial Sequence: Synthetic polynucleotide
ccuuggccacgccggcauccguuuuagagcuagaaauagcaaguuaaaauaaggcuaguccguuaucaacuugaaaaaguggcaccgagucggugcuuuu

SEQ ID NO: 387 - RNA, 100 nt, Artificial Sequence
  Description of Artificial Sequence: Synthetic polynucleotide
cagcggccgggaugccggcgguuuuagagcuagaaauagcaaguuaaaauaaggcuaguccguuaucaacuugaaaaaguggcaccgagucggugcuuuu

SEQ ID NO: 388 - RNA, 100 nt, Artificial Sequence
  Description of Artificial Sequence: Synthetic polynucleotide
ccgggaugccggcguggccaguuuuagagcuagaaauagcaaguuaaaauaaggcuaguccguuaucaacuugaaaaaguggcaccgagucggugcuuuu

SEQ ID NO: 389 - RNA, 100 nt, Artificial Sequence
  Description of Artificial Sequence: Synthetic polynucleotide
guggucagcggccgggaugcguuuuagagcuagaaauagcaaguuaaaauaaggcuaguccguuaucaacuugaaaaaguggcaccgagucggugcuuuu

SEQ ID NO: 390 - RNA, 100 nt, Artificial Sequence
  Description of Artificial Sequence: Synthetic polynucleotide
cgcugaccaccccugccaggguuuuagagcuagaaauagcaaguuaaaauaaggcuaguccguuaucaacuugaaaaaguggcaccgagucggugcuuuu

SEQ ID NO: 391 - RNA, 100 nt, Artificial Sequence
  Description of Artificial Sequence: Synthetic polynucleotide
ggcagggguggucagcggccguuuuagagcuagaaauagcaaguuaaaauaaggcuaguccguuaucaacuugaaaaaguggcaccgagucggugcuuuu

SEQ ID NO: 392 - RNA, 100 nt, Artificial Sequence
  Description of Artificial Sequence: Synthetic polynucleotide
gugcucaacugccaagggaaguuuuagagcuagaaauagcaaguuaaaauaaggcuaguccguuaucaacuugaaaaaguggcaccgagucggugcuuuu

SEQ ID NO: 393 - RNA, 100 nt, Artificial Sequence
  Description of Artificial Sequence: Synthetic polynucleotide
ucauggcacccaccuggcagguuuuagagcuagaaauagcaaguuaaaauaaggcuaguccguuaucaacuugaaaaaguggcaccgagucggugcuuuu

SEQ ID NO: 394 - RNA, 100 nt, Artificial Sequence
  Description of Artificial Sequence: Synthetic polynucleotide
uggcagggguggucagcggcguuuuagagcuagaaauagcaaguuaaaauaaggcuaguccguuaucaacuugaaaaaguggcaccgagucggugcuuuu

SEQ ID NO: 395 - RNA, 100 nt, Artificial Sequence
  Description of Artificial Sequence: Synthetic polynucleotide
gcugaccaccccugccagguguuuuagagcuagaaauagcaaguuaaaauaaggcuaguccguuaucaacuugaaaaaguggcaccgagucggugcuuuu

SEQ ID NO: 396 - RNA, 100 nt, Artificial Sequence
  Description of Artificial Sequence: Synthetic polynucleotide
ggccgcugaccaccccugccguuuuagagcuagaaauagcaaguuaaaauaaggcuaguccguuaucaacuugaaaaaguggcaccgagucggugcuuuu

SEQ ID NO: 397 - RNA, 100 nt, Artificial Sequence
  Description of Artificial Sequence: Synthetic polynucleotide
ggcaucgucccggaaguugcguuuuagagcuagaaauagcaaguuaaaauaaggcuaguccguuaucaacuugaaaaaguggcaccgagucggugcuuuu

SEQ ID NO: 398 - RNA, 100 nt, Artificial Sequence
  Description of Artificial Sequence: Synthetic polynucleotide
ggcuuuuccgaauaaacuccguuuuagagcuagaaauagcaaguuaaaauaaggcuaguccguuaucaacuugaaaaaguggcaccgagucggugcuuuu

SEQ ID NO: 399 - RNA, 100 nt, Artificial Sequence
  Description of Artificial Sequence: Synthetic polynucleotide
gucccggaaguugccggcagguuuuagagcuagaaauagcaaguuaaaauaaggcuaguccguuaucaacuugaaaaaguggcaccgagucggugcuuuu

SEQ ID NO: 400 - RNA, 100 nt, Artificial Sequence
  Description of Artificial Sequence: Synthetic polynucleotide
cggcuguacccacccgccagguuuuagagcuagaaauagcaaguuaaaauaaggcuaguccguuaucaacuugaaaaaguggcaccgagucggugcuuuu

SEQ ID NO: 401 - RNA, 100 nt, Artificial Sequence
  Description of Artificial Sequence: Synthetic polynucleotide
gucgugcuggucaccgcugcguuuuagagcuagaaauagcaaguuaaaauaaggcuaguccguuaucaacuugaaaaaguggcaccgagucggugcuuuu

SEQ ID NO: 402 - RNA, 100 nt, Artificial Sequence
  Description of Artificial Sequence: Synthetic polynucleotide
aguagaggcaggcaucguccguuuuagagcuagaaauagcaaguuaaaauaaggcuaguccguuaucaacuugaaaaaguggcaccgagucggugcuuuu

SEQ ID NO: 403 - RNA, 100 nt, Artificial Sequence
  Description of Artificial Sequence: Synthetic polynucleotide
uccgaauaaacuccaggccuguuuuagagcuagaaauagcaaguuaaaauaaggcuaguccguuaucaacuugaaaaaguggcaccgagucggugcuuuu

SEQ ID NO: 404 - RNA, 100 nt, Artificial Sequence
  Description of Artificial Sequence: Synthetic polynucleotide
guuuauucggaaaagccagcguuuuagagcuagaaauagcaaguuaaaauaaggcuaguccguuaucaacuugaaaaaguggcaccgagucggugcuuuu

SEQ ID NO: 405 - RNA, 100 nt, Artificial Sequence
  Description of Artificial Sequence: Synthetic polynucleotide
gcggcuguacccacccgccaguuuuagagcuagaaauagcaaguuaaaauaaggcuaguccguuaucaacuugaaaaaguggcaccgagucggugcuuuu

SEQ ID NO: 406 - RNA, 100 nt, Artificial Sequence
  Description of Artificial Sequence: Synthetic polynucleotide
caccgcugccggcaacuuccguuuuagagcuagaaauagcaaguuaaaauaaggcuaguccguuaucaacuugaaaaaguggcaccgagucggugcuuuu

SEQ ID NO: 407 - RNA, 100 nt, Artificial Sequence
  Description of Artificial Sequence: Synthetic polynucleotide
agcccucgccaggcgcuggcguuuuagagcuagaaauagcaaguuaaaauaaggcuaguccguuaucaacuugaaaaaguggcaccgagucggugcuuuu

SEQ ID NO: 408 - RNA, 100 nt, Artificial Sequence
  Description of Artificial Sequence: Synthetic polynucleotide
caacgccgccugccagcgccguuuuagagcuagaaauagcaaguuaaaauaaggcuaguccguuaucaacuugaaaaaguggcaccgagucggugcuuuu

SEQ ID NO: 409 - RNA, 100 nt, Artificial Sequence
  Description of Artificial Sequence: Synthetic polynucleotide
gcacgaccccagcccucgccguuuuagagcuagaaauagcaaguuaaaauaaggcuaguccguuaucaacuugaaaaaguggcaccgagucggugcuuuu

SEQ ID NO: 410 - RNA, 100 nt, Artificial Sequence
  Description of Artificial Sequence: Synthetic polynucleotide
ccgccugccagcgccuggcgguuuuagagcuagaaauagcaaguuaaaauaaggcuaguccguuaucaacuugaaaaaguggcaccgagucggugcuuuu

SEQ ID NO: 411 - RNA, 100 nt, Artificial Sequence
  Description of Artificial Sequence: Synthetic polynucleotide
ugccagcgccuggcgagggcguuuuagagcuagaaauagcaaguuaaaauaaggcuaguccguuaucaacuugaaaaaguggcaccgagucggugcuuuu

SEQ ID NO: 412 - RNA, 100 nt, Artificial Sequence
  Description of Artificial Sequence: Synthetic polynucleotide
ugcugcugccccuggcggguguuuuagagcuagaaauagcaaguuaaaauaaggcuaguccguuaucaacuugaaaaaguggcaccgagucggugcuuuu

SEQ ID NO: 413 - RNA, 100 nt, Artificial Sequence
  Description of Artificial Sequence: Synthetic polynucleotide
ucaccgcugccggcaacuucguuuuagagcuagaaauagcaaguuaaaauaaggcuaguccguuaucaacuugaaaaaguggcaccgagucggugcuuuu

SEQ ID NO: 414 - RNA, 100 nt, Artificial Sequence
  Description of Artificial Sequence: Synthetic polynucleotide
ggcgagggcuggggucgugcguuuuagagcuagaaauagcaaguuaaaauaaggcuaguccguuaucaacuugaaaaaguggcaccgagucggugcuuuu

SEQ ID NO: 415 - RNA, 100 nt, Artificial Sequence
  Description of Artificial Sequence: Synthetic polynucleotide
uuccgaauaaacuccaggccguuuuagagcuagaaauagcaaguuaaaauaaggcuaguccguuaucaacuugaaaaaguggcaccgagucggugcuuuu

SEQ ID NO: 416 - RNA, 100 nt, Artificial Sequence
  Description of Artificial Sequence: Synthetic polynucleotide
gugcugcugccccuggcgggguuuuagagcuagaaauagcaaguuaaaauaaggcuaguccguuaucaacuugaaaaaguggcaccgagucggugcuuuu

SEQ ID NO: 417 - RNA, 100 nt, Artificial Sequence
  Description of Artificial Sequence: Synthetic polynucleotide
gccagcgccuggcgagggcuguuuuagagcuagaaauagcaaguuaaaauaaggcuaguccguuaucaacuugaaaaaguggcaccgagucggugcuuuu

SEQ ID NO: 418 - RNA, 100 nt, Artificial Sequence
  Description of Artificial Sequence: Synthetic polynucleotide
ccucgccaggcgcuggcaggguuuuagagcuagaaauagcaaguuaaaauaaggcuaguccguuaucaacuugaaaaaguggcaccgagucggugcuuuu

SEQ ID NO: 419 - RNA, 100 nt, Artificial Sequence; identical to SEQ ID NO: 253
  Description of Artificial Sequence: Synthetic polynucleotide

SEQ ID NO: 420 - RNA, 100 nt, Artificial Sequence; identical to SEQ ID NO: 253
  Description of Artificial Sequence: Synthetic polynucleotide

SEQ ID NO: 421 - RNA, 100 nt, Artificial Sequence
  Description of Artificial Sequence: Synthetic polynucleotide
cccauaccuuggagcaacggguuuuagagcuagaaauagcaaguuaaaauaaggcuaguccguuaucaacuugaaaaaguggcaccgagucggugcuuuu

SEQ ID NO: 422 - RNA, 100 nt, Artificial Sequence
  Description of Artificial Sequence: Synthetic polynucleotide
gagauaccugaguaacuuucguuuuagagcuagaaauagcaaguuaaaauaaggcuaguccguuaucaacuugaaaaaguggcaccgagucggugcuuuu

SEQ ID NO: 423 - RNA, 100 nt, Artificial Sequence
  Description of Artificial Sequence: Synthetic polynucleotide
acgugggagaacuacaaauaguuuuagagcuagaaauagcaaguuaaaauaaggcuaguccguuaucaacuugaaaaaguggcaccgagucggugcuuuu

SEQ ID NO: 424 - RNA, 100 nt, Artificial Sequence
  Description of Artificial Sequence: Synthetic polynucleotide
cgauguugaauuaauguccaguuuuagagcuagaaauagcaaguuaaaauaaggcuaguccguuaucaacuugaaaaaguggcaccgagucggugcuuuu

SEQ ID NO: 425 - RNA, 100 nt, Artificial Sequence
  Description of Artificial Sequence: Synthetic polynucleotide
cacaaaacuucaaugaaacgguuuuagagcuagaaauagcaaguuaaaauaaggcuaguccguuaucaacuugaaaaaguggcaccgagucggugcuuuu

SEQ ID NO: 426 - RNA, 100 nt, Artificial Sequence
  Description of Artificial Sequence: Synthetic polynucleotide
uacgaauugaguuggaagacguuuuagagcuagaaauagcaaguuaaaauaaggcuaguccguuaucaacuugaaaaaguggcaccgagucggugcuuuu

SEQ ID NO: 427 - RNA, 100 nt, Artificial Sequence
  Description of Artificial Sequence: Synthetic polynucleotide
cuauggaguauaucuucucuguuuuagagcuagaaauagcaaguuaaaauaaggcuaguccguuaucaacuugaaaaaguggcaccgagucggugcuuuu

SEQ ID NO: 428 - RNA, 100 nt, Artificial Sequence
  Description of Artificial Sequence: Synthetic polynucleotide
cccgcaccuuggcgcagcggguuuuagagcuagaaauagcaaguuaaaauaaggcuaguccguuaacaacgggaaaccguggcaccgagucggugcuuuu

SEQ ID NO: 429 - DNA, 100 bp, Artificial Sequence
  Description of Artificial Sequence: Synthetic oligonucleotide
  Description of Combined DNA/RNA Molecule: Synthetic oligonucleotide
cccgcaccuuggcgcagcggguuuuagagcuagaaauagcaaguuaaaauaaggcuaguccguuaucaacuugaaaaaguggcaccgagucggugcuuuu

SEQ ID NO: 430 - DNA, 100 bp, Artificial Sequence; identical to SEQ ID NO: 429
  Description of Artificial Sequence: Synthetic oligonucleotide
  Description of Combined DNA/RNA Molecule: Synthetic oligonucleotide

SEQ ID NO: 431 - DNA, 100 bp, Artificial Sequence; identical to SEQ ID NO: 429
  Description of Artificial Sequence: Synthetic oligonucleotide
  Description of Combined DNA/RNA Molecule: Synthetic oligonucleotide

SEQ ID NO: 432 - DNA, 100 bp, Artificial Sequence; identical to SEQ ID NO: 429
  Description of Artificial Sequence: Synthetic oligonucleotide
  Description of Combined DNA/RNA Molecule: Synthetic oligonucleotide

SEQ ID NO: 433 - DNA, 100 bp, Artificial Sequence; identical to SEQ ID NO: 429
  Description of Artificial Sequence: Synthetic oligonucleotide
  Description of Combined DNA/RNA Molecule: Synthetic oligonucleotide

SEQ ID NO: 434 - DNA, 100 bp, Artificial Sequence; identical to SEQ ID NO: 429
  Description of Artificial Sequence: Synthetic oligonucleotide
  Description of Combined DNA/RNA Molecule: Synthetic oligonucleotide

SEQ ID NO: 435 - DNA, 100 bp, Artificial Sequence; identical to SEQ ID NO: 429
  Description of Artificial Sequence: Synthetic oligonucleotide
  Description of Combined DNA/RNA Molecule: Synthetic oligonucleotide

SEQ ID NO: 436 - RNA, 102 nt, Artificial Sequence
  Description of Artificial Sequence: Synthetic polynucleotide
cccgcaccuuggcgcagcgguuuuagagcuagaaauagcaaguuaaaauaaggcuaguccguuaucaacuugaaaaaguggcaccgagucggugcuuuuuuu

SEQ ID NO: 437 - RNA, 99 nt, Artificial Sequence
  Description of Artificial Sequence: Synthetic oligonucleotide
ccgcaccuuggcgcagcggguuuuagagcuagaaauagcaaguuaaaauaaggcuaguccguuaucaacuugaaaaaguggcaccgagucggugcuuuu

SEQ ID NO: 438 - RNA, 103 nt, Artificial Sequence
  Description of Artificial Sequence: Synthetic polynucleotide
aagauaccugaauaacccucguuuuagagcuagaaauagcaaguuaaaauaaggcuaguccguuaucaacuugaaaaaguggcaccgagucggugcuuuuuuu

SEQ ID NO: 439 - RNA, 100 nt, Artificial Sequence
  Description of Artificial Sequence: Synthetic polynucleotide
  modified_base (3)..(3): Inosine
aanauaccugaauaacccucguuuuagagcuagaaauagcaaguuaaaauaaggcuaguccguuaucaacuugaaaaaguggcaccgagucggugcuuuu

SEQ ID NO: 440 - RNA, 100 nt, Artificial Sequence
  Description of Artificial Sequence: Synthetic polynucleotide
  modified_base (3)..(3): Inosine
  modified_base (10)..(10): Inosine
aanauaccunaauaacccucguuuuagagcuagaaauagcaaguuaaaauaaggcuaguccguuaucaacuugaaaaaguggcaccgagucggugcuuuu

SEQ ID NO: 441 - RNA, 100 nt, Artificial Sequence
  Description of Artificial Sequence: Synthetic polynucleotide
  modified_base (10)..(10): Inosine
aagauaccunaauaacccucguuuuagagcuagaaauagcaaguuaaaauaaggcuaguccguuaucaacuugaaaaaguggcaccgagucggugcuuuu

SEQ ID NO: 442 - RNA, 99 nt, Artificial Sequence
  Description of Artificial Sequence: Synthetic oligonucleotide
agauaccugaauaacccucguuuuagagcuagaaauagcaaguuaaaauaaggcuaguccguuaucaacuugaaaaaguggcaccgagucggugcuuuu

SEQ ID NO: 443 - RNA, 98 nt, Artificial Sequence
  Description of Artificial Sequence: Synthetic oligonucleotide
gauaccugaauaacccucguuuuagagcuagaaauagcaaguuaaaauaaggcuaguccguuaucaacuugaaaaaguggcaccgagucggugcuuuu

SEQ ID NO: 444 - RNA, 97 nt, Artificial Sequence
  Description of Artificial Sequence: Synthetic oligonucleotide
auaccugaauaacccucguuuuagagcuagaaauagcaaguuaaaauaaggcuaguccguuaucaacuugaaaaaguggcaccgagucggugcuuuu

SEQ ID NO: 445 - RNA, 103 nt, Artificial Sequence
  Description of Artificial Sequence: Synthetic polynucleotide
aagauaccugaauaacucucguuuuagagcuagaaauagcaaguuaaaauaaggcuaguccguuaucaacuugaaaaaguggcaccgagucggugcuuuuuuu

SEQ ID NO: 446 - RNA, 100 nt, Artificial Sequence
  Description of Artificial Sequence: Synthetic polynucleotide
ggcugaugaggccgcacaugguuuuagagcuagaaauagcaaguuaaaauaaggcuaguccguuaucaacuugaaaaaguggcaccgagucggugcuuuu

SEQ ID NO: 447 - RNA, 103 nt, Artificial Sequence
  Description of Artificial Sequence: Synthetic polynucleotide
ucagcuccaggcgguccuggguuuuagagcuagaaauagcaaguuaaaauaaggcuaguccguuaucaacuugaaaaaguggcaccgagucggugcuuuuuuu

SEQ ID NO: 448 - RNA, 103 nt, Artificial Sequence; identical to SEQ ID NO: 447
  Description of Artificial Sequence: Synthetic polynucleotide

SEQ ID NO: 449 - RNA, 103 nt, Artificial Sequence; identical to SEQ ID NO: 447
  Description of Artificial Sequence: Synthetic polynucleotide

SEQ ID NO: 450 - RNA, 100 nt, Artificial Sequence; identical to SEQ ID NO: 339
  Description of Artificial Sequence: Synthetic polynucleotide

SEQ ID NO: 451 - RNA, 100 nt, Artificial Sequence; identical to SEQ ID NO: 339
  Description of Artificial Sequence: Synthetic polynucleotide

SEQ ID NO: 452 - RNA, 100 nt, Artificial Sequence
  Description of Artificial Sequence: Synthetic polynucleotide
cgccugccagcgccuggcgaguuuuagagcuagaaauagcaaguuaaaauaaggcuaguccguuaucaacuugaaaaaguggcaccgagucggugcuuuu

SEQ ID NO: 453 - DNA, 22 bp, Artificial Sequence
  Description of Artificial Sequence: Synthetic oligonucleotide
ctagcacctgccccagcggtgg

SEQ ID NO: 454 - DNA, 23 bp, Artificial Sequence
  Description of Artificial Sequence: Synthetic oligonucleotide
tccctaccctggcacagcagggg

SEQ ID NO: 455 - DNA, 23 bp, Artificial Sequence
  Description of Artificial Sequence: Synthetic oligonucleotide
cccacactcagacgcagcgaggg

SEQ ID NO: 456 - DNA, 21 bp, Artificial Sequence
  Description of Artificial Sequence: Synthetic oligonucleotide
cccgcactggagcagcaggga

SEQ ID NO: 457 - DNA, 24 bp, Artificial Sequence
  Description of Artificial Sequence: Synthetic oligonucleotide
cttgcaccttggtagcagctgggg

SEQ ID NO: 458 - DNA, 23 bp, Artificial Sequence
  Description of Artificial Sequence: Synthetic oligonucleotide
ctggcaccatggcccagcagtgg

SEQ ID NO: 459 - DNA, 23 bp, Artificial Sequence
  Description of Artificial Sequence: Synthetic oligonucleotide
actgcatcttagtgcagaggtgg

SEQ ID NO: 460 - DNA, 23 bp, Artificial Sequence
  Description of Artificial Sequence: Synthetic oligonucleotide
tccacaccttggcgcactggaag

SEQ ID NO: 461 - DNA, 23 bp, Artificial Sequence
  Description of Artificial Sequence: Synthetic oligonucleotide
cattcaccttgtcacagctgggg

SEQ ID NO: 462 - DNA, 23 bp, Artificial Sequence
  Description of Artificial Sequence: Synthetic oligonucleotide
accgcaccattgcacagcctagg

SEQ ID NO: 463 - DNA, 24 bp, Artificial Sequence
  Description of Artificial Sequence: Synthetic oligonucleotide
gccgcaccatgggcacagcgggga

SEQ ID NO: 464 - DNA, 22 bp, Artificial Sequence
  Description of Artificial Sequence: Synthetic oligonucleotide
cccatacctggcacagcggtgg

SEQ ID NO: 465 - DNA, 22 bp, Artificial Sequence
  Description of Artificial Sequence: Synthetic oligonucleotide
caagcacctggctcagaggtgg

SEQ ID NO: 466 - DNA, 22 bp, Artificial Sequence
  Description of Artificial Sequence: Synthetic oligonucleotide
accgcacctggcacagtggaag

SEQ ID NO: 467 - DNA, 23 bp, Artificial Sequence
  Description of Artificial Sequence: Synthetic oligonucleotide
ccccacccttggcacagagcagg

SEQ ID NO: 468 - DNA, 22 bp, Artificial Sequence
  Description of Artificial Sequence: Synthetic oligonucleotide
ccagcacctagcgcagagctgg

SEQ ID NO: 469 - DNA, 22 bp, Artificial Sequence
  Description of Artificial Sequence: Synthetic oligonucleotide
cccgcacctacctcagcagggg

SEQ ID NO: 470 - DNA, 23 bp, Artificial Sequence
  Description of Artificial Sequence: Synthetic oligonucleotide
cccgcaccccaccgcagcggggg

SEQ ID NO: 471 - DNA, 23 bp, Artificial Sequence
  Description of Artificial Sequence: Synthetic oligonucleotide
tctttaccttggagcagctgagg

SEQ ID NO: 472 - DNA, 23 bp, Artificial Sequence
  Description of Artificial Sequence: Synthetic oligonucleotide
cccgcaccacagtgcaccggggg

SEQ ID NO: 473 - DNA, 23 bp, Artificial Sequence
  Description of Artificial Sequence: Synthetic oligonucleotide
cctccacaatggcgcaggggcgg

SEQ ID NO: 474 - DNA, 22 bp, Artificial Sequence
  Description of Artificial Sequence: Synthetic oligonucleotide
ccagcacctggcacagaagagg

SEQ ID NO: 475 - DNA, 23 bp, Artificial Sequence
  Description of Artificial Sequence: Synthetic oligonucleotide
accgcaccaaggtgcataggagg

SEQ ID NO: 476 - DNA, 22 bp, Artificial Sequence
  Description of Artificial Sequence: Synthetic oligonucleotide
ccagcacttgccccagcagagg

SEQ ID NO: 477 - DNA, 23 bp, Artificial Sequence
  Description of Artificial Sequence: Synthetic oligonucleotide
ctcccaccctggcccagcggggg

SEQ ID NO: 478 - DNA, 23 bp, Artificial Sequence
  Description of Artificial Sequence: Synthetic oligonucleotide
acagcaccttggcccagaggcga

SEQ ID NO: 479 - DNA, 23 bp, Artificial Sequence
  Description of Artificial Sequence: Synthetic oligonucleotide
acggcaccttgggctagcggggg

SEQ ID NO: 480 - DNA, 23 bp, Artificial Sequence
  Description of Artificial Sequence: Synthetic oligonucleotide
cccgcacccagctgcagccgagg

SEQ ID NO: 481 - DNA, 22 bp, Artificial Sequence
  Description of Artificial Sequence: Synthetic oligonucleotide
ccagcacctggtgcagagtagg

SEQ ID NO: 482 - DNA, 23 bp, Artificial Sequence
  Description of Artificial Sequence: Synthetic oligonucleotide
cccacacctgggcccagtggagg

SEQ ID NO: 483 - DNA, 22 bp, Artificial Sequence
  Description of Artificial Sequence: Synthetic oligonucleotide
ccagcacctggtgcagcttagg

SEQ ID NO: 484 - DNA, 23 bp, Artificial Sequence
  Description of Artificial Sequence: Synthetic oligonucleotide
tccacacaatggcacagcagagg

SEQ ID NO: 485 - DNA, 22 bp, Artificial Sequence
  Description of Artificial Sequence: Synthetic oligonucleotide
cccgcacctggctcagagggtc

SEQ ID NO: 486 - DNA, 24 bp, Artificial Sequence
  Description of Artificial Sequence: Synthetic oligonucleotide
cgggcaccatggcagcagcggagg

SEQ ID NO: 487 - DNA, 23 bp, Artificial Sequence
  Description of Artificial Sequence: Synthetic oligonucleotide
cccacaccatggcccagtgagag

SEQ ID NO: 488 - DNA, 22 bp, Artificial Sequence
  Description of Artificial Sequence: Synthetic oligonucleotide
ccagcacctggcacagtgaagg

SEQ ID NO: 489 - DNA, 23 bp, Artificial Sequence
  Description of Artificial Sequence: Synthetic oligonucleotide
cccacacatggccacagcagtgg

SEQ ID NO: 490 - DNA, 23 bp, Artificial Sequence
  Description of Artificial Sequence: Synthetic oligonucleotide
ctggcaccttagcacagaggagg

SEQ ID NO: 491 - DNA, 23 bp, Artificial Sequence
  Description of Artificial Sequence: Synthetic oligonucleotide
cccgcaccagagcgcagggggag

SEQ ID NO: 492 - DNA, 22 bp, Artificial Sequence
  Description of Artificial Sequence: Synthetic oligonucleotide
gccacacctggcccagcagggg

SEQ ID NO: 493 - DNA, 23 bp, Artificial Sequence
  Description of Artificial Sequence: Synthetic oligonucleotide
cccgcaccagggcgcagatggag

SEQ ID NO: 494 - DNA, 23 bp, Artificial Sequence
  Description of Artificial Sequence: Synthetic oligonucleotide
tccacacctcagcacagcagagg

SEQ ID NO: 495 - DNA, 23 bp, Artificial Sequence
  Description of Artificial Sequence: Synthetic oligonucleotide
accgcaccttggcccagtgctgg

SEQ ID NO: 496 - DNA, 22 bp, Artificial Sequence
  Description of Artificial Sequence: Synthetic oligonucleotide
accgcagctggcgcagcatggg

SEQ ID NO: 497 - DNA, 22 bp, Artificial Sequence
  Description of Artificial Sequence: Synthetic oligonucleotide
cccgcatttgcctcagcggtgg

SEQ ID NO: 498 - DNA, 22 bp, Artificial Sequence
  Description of Artificial Sequence: Synthetic oligonucleotide
ccagcacttggcacagcagtgg

SEQ ID NO: 499 - DNA, 24 bp, Artificial Sequence
  Description of Artificial Sequence: Synthetic oligonucleotide
cccacaccttggtgtcagcggagg

SEQ ID NO: 500 - DNA, 22 bp, Artificial Sequence
  Description of Artificial Sequence: Synthetic oligonucleotide
cctgcacccggagcagcagggg

SEQ ID NO: 501 - DNA, 23 bp, Artificial Sequence
  Description of Artificial Sequence: Synthetic oligonucleotide
cctccaccttggcccagtggagg

SEQ ID NO: 502 - DNA, 23 bp, Artificial Sequence
  Description of Artificial Sequence: Synthetic oligonucleotide
ctcccaccctggcgcagaggagg

SEQ ID NO: 503 - DNA, 22 bp, Artificial Sequence
  Description of Artificial Sequence: Synthetic oligonucleotide
tcagcacctggtgcagaggagg

SEQ ID NO: 504 - DNA, 23 bp, Artificial Sequence
  Description of Artificial Sequence: Synthetic oligonucleotide
cgagcaccatggcgcagccccgg

SEQ ID NO: 505 - DNA, 22 bp, Artificial Sequence
  Description of Artificial Sequence: Synthetic oligonucleotide
cccgcacttggagcagccggcg

SEQ ID NO: 506 - DNA, 23 bp, Artificial Sequence
  Description of Artificial Sequence: Synthetic oligonucleotide
ggagcaccttgacccagcagagg

SEQ ID NO: 507 - DNA, 22 bp, Artificial Sequence
  Description of Artificial Sequence: Synthetic oligonucleotide
ccagcacttagcccagcagcgg

SEQ ID NO: 508 - DNA, 23 bp, Artificial Sequence
  Description of Artificial Sequence: Synthetic oligonucleotide
cccgcacctcggcacagctaggg

SEQ ID NO: 509 - DNA, 23 bp, Artificial Sequence
  Description of Artificial Sequence: Synthetic oligonucleotide
gccccatcttggcccagcggagg

SEQ ID NO: 510 - DNA, 23 bp, Artificial Sequence
  Description of Artificial Sequence: Synthetic oligonucleotide
ctagaaccatggtgcagaggggg

SEQ ID NO: 511 - DNA, 23 bp, Artificial Sequence
  Description of Artificial Sequence: Synthetic oligonucleotide
atcccacctcggcacagctgggg

SEQ ID NO: 512 - DNA, 23 bp, Artificial Sequence
  Description of Artificial Sequence: Synthetic oligonucleotide
cccgcaccgtggtacagcctgtg

SEQ ID NO: 513 - DNA, 22 bp, Artificial Sequence
  Description of Artificial Sequence: Synthetic oligonucleotide
cccgcaccaggcccagctggcg

SEQ ID NO: 514 - DNA, 23 bp, Artificial Sequence
  Description of Artificial Sequence: Synthetic oligonucleotide
cccacaccttggtgcagctctgt

SEQ ID NO: 515 - DNA, 22 bp, Artificial Sequence
  Description of Artificial Sequence: Synthetic oligonucleotide
accacacctgtcccagcggagg

SEQ ID NO: 516 - DNA, 23 bp, Artificial Sequence
  Description of Artificial Sequence: Synthetic oligonucleotide
cacactacttggcacagaggagg

SEQ ID NO: 517 - DNA, 22 bp, Artificial Sequence
  Description of Artificial Sequence: Synthetic oligonucleotide
accgcactcagagcagcggagg

SEQ ID NO: 518 - DNA, 22 bp, Artificial Sequence
  Description of Artificial Sequence: Synthetic oligonucleotide
tccgcacttggctcagcggggc

SEQ ID NO: 519 - DNA, 23 bp, Artificial Sequence
  Description of Artificial Sequence: Synthetic oligonucleotide
ccccgcactcggagcagcggcgg

SEQ ID NO: 520 - DNA, 24 bp, Artificial Sequence
  Description of Artificial Sequence: Synthetic oligonucleotide
tccgcaccctgagagcagtggagg

SEQ ID NO: 521 - DNA, 23 bp, Artificial Sequence
  Description of Artificial Sequence: Synthetic oligonucleotide
ccctgcacttggtgcagctgggg

SEQ ID NO: 522 - DNA, 22 bp, Artificial Sequence
  Description of Artificial Sequence: Synthetic oligonucleotide
accgcacctgacccagtggtgg

SEQ ID NO: 523 - DNA, 23 bp, Artificial Sequence
  Description of Artificial Sequence: Synthetic oligonucleotide
ctcctaccatggcacagctgagg

SEQ ID NO: 524 - DNA, 23 bp, Artificial Sequence
  Description of Artificial Sequence: Synthetic oligonucleotide
cccacaccagggcgcagctgaag

SEQ ID NO: 525 - DNA, 23 bp, Artificial Sequence
  Description of Artificial Sequence: Synthetic oligonucleotide
ccagtaccttggcccagctttgg

SEQ ID NO: 526 - DNA, 22 bp, Artificial Sequence
  Description of Artificial Sequence: Synthetic oligonucleotide
acagcacctggcacagtggtgg

SEQ ID NO: 527 - DNA, 22 bp, Artificial Sequence
  Description of Artificial Sequence: Synthetic oligonucleotide
cccacacctggagcaccagggg

SEQ ID NO: 528 - DNA, 24 bp, Artificial Sequence
  Description of Artificial Sequence: Synthetic oligonucleotide
caagcaccttggcagcagctgagg

SEQ ID NO: 529 - DNA, 23 bp, Artificial Sequence
  Description of Artificial Sequence: Synthetic oligonucleotide
cccatgccttagcacagcgatgg

SEQ ID NO: 530 - DNA, 23 bp, Artificial Sequence
  Description of Artificial Sequence: Synthetic oligonucleotide
ctctatccttggcccagcagtgg

SEQ ID NO: 531 - DNA, 23 bp, Artificial Sequence
  Description of Artificial Sequence: Synthetic oligonucleotide
cccgcaccttgccgcagcggccc

SEQ ID NO: 532 - DNA, 23 bp, Artificial Sequence
  Description of Artificial Sequence: Synthetic oligonucleotide
atggcaccttggcacatcagagg

SEQ ID NO: 533 - DNA, 23 bp, Artificial Sequence
  Description of Artificial Sequence: Synthetic oligonucleotide
tccccacactgtcgcagaggagg

SEQ ID NO: 534 - DNA, 23 bp, Artificial Sequence
  Description of Artificial Sequence: Synthetic oligonucleotide
ccagcaccatggcacagagaggt

SEQ ID NO: 535 - DNA, 22 bp, Artificial Sequence
  Description of Artificial Sequence: Synthetic oligonucleotide
acagcacctggcacagaggagg

SEQ ID NO: 536 - DNA, 23 bp, Artificial Sequence
  Description of Artificial Sequence: Synthetic oligonucleotide
accgcacctggcagcagccgtgg

SEQ ID NO: 537 - DNA, 22 bp, Artificial Sequence
  Description of Artificial Sequence: Synthetic oligonucleotide
ccagcacctggagcagccgagg

SEQ ID NO: 538 - DNA, 22 bp, Artificial Sequence
  Description of Artificial Sequence: Synthetic oligonucleotide
ccagcacctggcacaaaggagg

SEQ ID NO: 539 - DNA, 23 bp, Artificial Sequence
  Description of Artificial Sequence: Synthetic oligonucleotide
gaggcaccttggaccagcagcgg

SEQ ID NO: 540 - DNA, 22 bp, Artificial Sequence
  Description of Artificial Sequence: Synthetic oligonucleotide
cccgcacttggagcagccggtg

SEQ ID NO: 541 - DNA, 22 bp, Artificial Sequence
  Description of Artificial Sequence: Synthetic oligonucleotide
ccagcacttagtgcagcgcagg

SEQ ID NO: 542 - DNA, 22 bp, Artificial Sequence
  Description of Artificial Sequence: Synthetic oligonucleotide
cccacacctggagcagcaggag

SEQ ID NO: 543 - DNA, 22 bp, Artificial Sequence
  Description of Artificial Sequence: Synthetic oligonucleotide
cccacaccaggcacggcggggg

SEQ ID NO: 544 - DNA, 22 bp, Artificial Sequence
  Description of Artificial Sequence: Synthetic oligonucleotide
ccctcaccagccgcagcagggg

SEQ ID NO: 545 - DNA, 24 bp, Artificial Sequence
  Description of Artificial Sequence: Synthetic oligonucleotide
cacccgacttggcgacagcggggg

SEQ ID NO: 546 - DNA, 22 bp, Artificial Sequence
  Description of Artificial Sequence: Synthetic oligonucleotide
accgcacctggcacagaagggg

SEQ ID NO: 547 - DNA, 22 bp, Artificial Sequence
  Description of Artificial Sequence: Synthetic oligonucleotide
accacacctggcccagcagtgg

SEQ ID NO: 548 - DNA, 22 bp, Artificial Sequence
  Description of Artificial Sequence: Synthetic oligonucleotide
ccctcaccgggcacagaggagg

SEQ ID NO: 549 - DNA, 22 bp, Artificial Sequence
  Description of Artificial Sequence: Synthetic oligonucleotide
ccagtacctggcccagaggagg

SEQ ID NO: 550 - DNA, 22 bp, Artificial Sequence
  Description of Artificial Sequence: Synthetic oligonucleotide
cccgcaccaggcgcaggtggag

SEQ ID NO: 551 - DNA, 24 bp, Artificial Sequence
  Description of Artificial Sequence: Synthetic oligonucleotide
caggcaccttggcggcagccgcgg

SEQ ID NO: 552 - DNA, 23 bp, Artificial Sequence
  Description of Artificial Sequence: Synthetic oligonucleotide
tgtgcaccatggcacagcgggga

SEQ ID NO: 553 - DNA, 23 bp, Artificial Sequence
  Description of Artificial Sequence: Synthetic oligonucleotide
cccgcacacagacgcagagcagg

SEQ ID NO: 554 - DNA, 22 bp, Artificial Sequence
  Description of Artificial Sequence: Synthetic oligonucleotide
tccacacctggcccagctgtgg

SEQ ID NO: 555 - DNA, 21 bp, Artificial Sequence
  Description of Artificial Sequence: Synthetic oligonucleotide
cctgcactggcccagcagcgg

SEQ ID NO: 556 - DNA, 22 bp, Artificial Sequence
  Description of Artificial Sequence: Synthetic oligonucleotide
cctgcactagccgcaacggggg

SEQ ID NO: 557 - DNA, 23 bp, Artificial Sequence
  Description of Artificial Sequence: Synthetic oligonucleotide
tgagcaccttggggcagctgggg

SEQ ID NO: 558 - DNA, 22 bp, Artificial Sequence
  Description of Artificial Sequence: Synthetic oligonucleotide
cccgcacttggcgcagctggcc

SEQ ID NO: 559 - DNA, 24 bp, Artificial Sequence
  Description of Artificial Sequence: Synthetic oligonucleotide
ccagcaccttggcagcagcaccgg

SEQ ID NO: 560 - DNA, 23 bp, Artificial Sequence
  Description of Artificial Sequence: Synthetic oligonucleotide
tcccccacttggcacagctgggg

SEQ ID NO: 561 - DNA, 22 bp, Artificial Sequence
  Description of Artificial Sequence: Synthetic oligonucleotide
ccagcacagggcgcagaggtgg

SEQ ID NO: 562 - DNA, 23 bp, Artificial Sequence
  Description of Artificial Sequence: Synthetic oligonucleotide
cccaccccttagcacagcaatgg

SEQ ID NO: 563 - DNA, 23 bp, Artificial Sequence
  Description of Artificial Sequence: Synthetic oligonucleotide
cccacaccgtggcccagaggtgg

SEQ ID NO: 564 - DNA, 22 bp, Artificial Sequence
  Description of Artificial Sequence: Synthetic oligonucleotide
ccagcacctggcacagcatagg

SEQ ID NO: 565 - DNA, 23 bp, Artificial Sequence
  Description of Artificial Sequence: Synthetic oligonucleotide
accactacctggcccagcggtgg

SEQ ID NO: 566 - DNA, 23 bp, Artificial Sequence
  Description of Artificial Sequence: Synthetic oligonucleotide
tccgcaccttggtccagcagggg

SEQ ID NO: 567 - DNA, 22 bp, Artificial Sequence
  Description of Artificial Sequence: Synthetic oligonucleotide
tacgcacctggctcagcagagg

SEQ ID NO: 568 - DNA, 23 bp, Artificial Sequence
  Description of Artificial Sequence: Synthetic oligonucleotide
agcccagcatggcgcagaggtgg

SEQ ID NO: 569 - DNA, 22 bp, Artificial Sequence
  Description of Artificial Sequence: Synthetic oligonucleotide
ccagcacctggcacagaggaga

SEQ ID NO: 570 - DNA, 22 bp, Artificial Sequence
  Description of Artificial Sequence: Synthetic oligonucleotide
accgcacctggcccagatgggg

SEQ ID NO: 571 - DNA, 22 bp, Artificial Sequence
  Description of Artificial Sequence: Synthetic oligonucleotide
cccgcacctggctcagaggggt

SEQ ID NO: 572 - DNA, 22 bp, Artificial Sequence
  Description of Artificial Sequence: Synthetic oligonucleotide
accgcacctggcccagtggagg

SEQ ID NO: 573 - DNA, 23 bp, Artificial Sequence
  Description of Artificial Sequence: Synthetic oligonucleotide
cccacatcctggcccagcagggg

SEQ ID NO: 574 - DNA, 22 bp, Artificial Sequence
  Description of Artificial Sequence: Synthetic oligonucleotide
cctgcaccaggctcagtggggg

SEQ ID NO: 575 - DNA, 24 bp, Artificial Sequence
  Description of Artificial Sequence: Synthetic oligonucleotide
cgagcaccttggcagcagctgagg

SEQ ID NO: 576 - DNA, 22 bp, Artificial Sequence
  Description of Artificial Sequence: Synthetic oligonucleotide
accgcacctggcccagagtagg

SEQ ID NO: 577 - DNA, 22 bp, Artificial Sequence
  Description of Artificial Sequence: Synthetic oligonucleotide
acagcacctggcgcagagcggg

SEQ ID NO: 578 - DNA, 23 bp, Artificial Sequence
  Description of Artificial Sequence: Synthetic oligonucleotide
actccaccatggcacagcgtggg

SEQ ID NO: 579 - DNA, 22 bp, Artificial Sequence
  Description of Artificial Sequence: Synthetic oligonucleotide
accacacctggcccagaggagg

SEQ ID NO: 580 - DNA, 23 bp, Artificial Sequence
  Description of Artificial Sequence: Synthetic oligonucleotide
gcggcaccttggcccagcgtggg

SEQ ID NO: 581 - DNA, 23 bp, Artificial Sequence
  Description of Artificial Sequence: Synthetic oligonucleotide
cctgcacctgagcacagaggagg

SEQ ID NO: 582 - DNA, 22 bp, Artificial Sequence
  Description of Artificial Sequence: Synthetic oligonucleotide
cccgcaccctgtgcagccgagg

SEQ ID NO: 583 - DNA, 22 bp, Artificial Sequence
  Description of Artificial Sequence: Synthetic oligonucleotide
cccactcttggcacaggggagg

SEQ ID NO: 584 - DNA, 22 bp, Artificial Sequence
  Description of Artificial Sequence: Synthetic oligonucleotide
cccgcaccaggtgcaggagtgg

SEQ ID NO: 585 - DNA, 22 bp, Artificial Sequence
  Description of Artificial Sequence: Synthetic oligonucleotide
accgcacctggcccagcaaagg

SEQ ID NO: 586 - DNA, 23 bp, Artificial Sequence
  Description of Artificial Sequence: Synthetic oligonucleotide
gctgcaccttagcacagtgaagg

SEQ ID NO: 587 - DNA, 23 bp, Artificial Sequence
  Description of Artificial Sequence: Synthetic oligonucleotide
tcagcaccttggcgaagccttgg

SEQ ID NO: 588 - DNA, 22 bp, Artificial Sequence
  Description of Artificial Sequence: Synthetic oligonucleotide
accgcacctggcccaaaggggg

SEQ ID NO: 589 - DNA, 23 bp, Artificial Sequence
  Description of Artificial Sequence: Synthetic oligonucleotide
ccctcaccctggcacagccgggg

SEQ ID NO: 590 - DNA, 23 bp, Artificial Sequence
  Description of Artificial Sequence: Synthetic oligonucleotide
ttcacaccttggtgcagaggtga

SEQ ID NO: 591 - DNA, 22 bp, Artificial Sequence
  Description of Artificial Sequence: Synthetic oligonucleotide
ccagcacctagcgcagcggctg

SEQ ID NO: 592 - DNA, 22 bp, Artificial Sequence
  Description of Artificial Sequence: Synthetic oligonucleotide
accgcacctggcccatcagggg

SEQ ID NO: 593 - DNA, 22 bp, Artificial Sequence
  Description of Artificial Sequence: Synthetic oligonucleotide
cccgcacctggctcagcgggtc

SEQ ID NO: 594 - DNA, 22 bp, Artificial Sequence
  Description of Artificial Sequence: Synthetic oligonucleotide
tcagcacctggagcagccgagg

SEQ ID NO: 595 - DNA, 23 bp, Artificial Sequence
  Description of Artificial Sequence: Synthetic oligonucleotide
ccccacccttggtgcagaggagg

SEQ ID NO: 596 - DNA, 23 bp, Artificial Sequence
  Description of Artificial Sequence: Synthetic oligonucleotide
catacaccttgccgcagccaggg

SEQ ID NO: 597 - DNA, 23 bp, Artificial Sequence
  Description of Artificial Sequence: Synthetic oligonucleotide
cacacaccttagcacagccaagg

SEQ ID NO: 598 - DNA, 22 bp, Artificial Sequence
  Description of Artificial Sequence: Synthetic oligonucleotide
ctagcacctggcacagtggtgg

SEQ ID NO: 599 - DNA, 22 bp, Artificial Sequence
  Description of Artificial Sequence: Synthetic oligonucleotide
accgtacctggcccagaggagg

SEQ ID NO: 600 - DNA, 23 bp, Artificial Sequence
  Description of Artificial Sequence: Synthetic oligonucleotide
gccccaccttaatgcagcggggg

SEQ ID NO: 601 - DNA, 23 bp, Artificial Sequence
  Description of Artificial Sequence: Synthetic oligonucleotide
ccagctacatggcccagaggagg

SEQ ID NO: 602 - DNA, 22 bp, Artificial Sequence
  Description of Artificial Sequence: Synthetic oligonucleotide
cccacaccatgcgcagagtggg

SEQ ID NO: 603 - DNA, 22 bp, Artificial Sequence
  Description of Artificial Sequence: Synthetic oligonucleotide
cccgcacccaggccagctgtgg

SEQ ID NO: 604 - DNA, 22 bp, Artificial Sequence
  Description of Artificial Sequence: Synthetic oligonucleotide
ccagcacctgctgcagcgatgg

SEQ ID NO: 605 - DNA, 23 bp, Artificial Sequence
  Description of Artificial Sequence: Synthetic oligonucleotide
tccgcaccttggcccagttgaag

SEQ ID NO: 606 - DNA, 24 bp, Artificial Sequence
  Description of Artificial Sequence: Synthetic oligonucleotide
acagcaccttggcagcagaggtgg

SEQ ID NO: 607 - DNA, 22 bp, Artificial Sequence
  Description of Artificial Sequence: Synthetic oligonucleotide
cccgcaccaggctcagcagcag

SEQ ID NO: 608 - DNA, 22 bp, Artificial Sequence
  Description of Artificial Sequence: Synthetic oligonucleotide
ccagcacctggcacagccaggg

SEQ ID NO: 609 - DNA, 23 bp, Artificial Sequence
  Description of Artificial Sequence: Synthetic oligonucleotide
gctgcaccctgccacagaggagg

SEQ ID NO: 610 - DNA, 23 bp, Artificial Sequence
  Description of Artificial Sequence: Synthetic oligonucleotide
ccagcaccctagtgcagagtggg

SEQ ID NO: 611 - DNA, 22 bp, Artificial Sequence
  Description of Artificial Sequence: Synthetic oligonucleotide
cccgcacctggcacagcaccag

SEQ ID NO: 612 - DNA, 22 bp, Artificial Sequence
  Description of Artificial Sequence: Synthetic oligonucleotide
cccgaccctgacgcagcctggg

SEQ ID NO: 613 - DNA, 23 bp, Artificial Sequence
  Description of Artificial Sequence: Synthetic oligonucleotide
cccgcaccctatcacagcagagg

SEQ ID NO: 614 - DNA, 22 bp, Artificial Sequence
  Description of Artificial Sequence: Synthetic oligonucleotide
ctcgcaccaggcgcagccgtgg

SEQ ID NO: 615 - DNA, 23 bp, Artificial Sequence
  Description of Artificial Sequence: Synthetic oligonucleotide
catgtaccttgccacagcagggg

SEQ ID NO: 616 - DNA, 24 bp, Artificial Sequence
  Description of Artificial Sequence: Synthetic oligonucleotide
cgagcaccttggcggcagctgagg

SEQ ID NO: 617 - DNA, 23 bp, Artificial Sequence
  Description of Artificial Sequence: Synthetic oligonucleotide
tccacacctaggcacagcctagg

SEQ ID NO: 618 - DNA, 23 bp, Artificial Sequence
  Description of Artificial Sequence: Synthetic oligonucleotide
ccagcaccaaggctcagctgagg

SEQ ID NO: 619 - DNA, 22 bp, Artificial Sequence
  Description of Artificial Sequence: Synthetic oligonucleotide
accgcacctggcacattggagg

SEQ ID NO: 620 - DNA, 23 bp, Artificial Sequence
  Description of Artificial Sequence: Synthetic oligonucleotide
cccacaccttggcccagccctgg

SEQ ID NO: 621 - DNA, 22 bp, Artificial Sequence
  Description of Artificial Sequence: Synthetic oligonucleotide
gccgcacctgccgcagccgtgg

SEQ ID NO: 622 - DNA, 22 bp, Artificial Sequence
  Description of Artificial Sequence: Synthetic oligonucleotide
cccgcactgggtgcagtggtgg

SEQ ID NO: 623 - DNA, 23 bp, Artificial Sequence
  Description of Artificial Sequence: Synthetic oligonucleotide
cccacacccaggtgcagcggcag

SEQ ID NO: 624 - DNA, 22 bp, Artificial Sequence
  Description of Artificial Sequence: Synthetic oligonucleotide
ccagcacctggcacagcaggtg

SEQ ID NO: 625 - DNA, 23 bp, Artificial Sequence
  Description of Artificial Sequence: Synthetic oligonucleotide
cccgcatcttggtgcagctgctt

SEQ ID NO: 626 - DNA, 23 bp, Artificial Sequence
  Description of Artificial Sequence: Synthetic oligonucleotide
accgcaccatggtgcagctgggc

SEQ ID NO: 627 - DNA, 22 bp, Artificial Sequence
  Description of Artificial Sequence: Synthetic oligonucleotide
ccaacacctggcgcagagtagg

SEQ ID NO: 628 - DNA, 23 bp, Artificial Sequence
  Description of Artificial Sequence: Synthetic oligonucleotide
ctcgtaccaaagcgcagaggagg

SEQ ID NO: 629 - DNA, 22 bp, Artificial Sequence
  Description of Artificial Sequence: Synthetic oligonucleotide
cccgcactcggtgcagcggtat

SEQ ID NO: 630 - DNA, 22 bp, Artificial Sequence
  Description of Artificial Sequence: Synthetic oligonucleotide
cccgcactgggtgcagcggaag

SEQ ID NO: 631 - DNA, 22 bp, Artificial Sequence
  Description of Artificial Sequence: Synthetic oligonucleotide
gccgcacttggcgcagctgtgg

SEQ ID NO: 632 - DNA, 23 bp, Artificial Sequence
  Description of Artificial Sequence: Synthetic oligonucleotide
ctaacaccttggtgcagaggtgg

SEQ ID NO: 633 - DNA, 23 bp, Artificial Sequence
  Description of Artificial Sequence: Synthetic oligonucleotide
cctacaccatggcgcagcgtcag

SEQ ID NO: 634 - DNA, 22 bp, Artificial Sequence
  Description of Artificial Sequence: Synthetic oligonucleotide
ccagcacctggcacatcggtgg

SEQ ID NO: 635 - DNA, 22 bp, Artificial Sequence
  Description of Artificial Sequence: Synthetic oligonucleotide
cccgcacatggtgcagtggctg

SEQ ID NO: 636 - DNA, 22 bp, Artificial Sequence
  Description of Artificial Sequence: Synthetic oligonucleotide
cccacccctggcccagccgagg

SEQ ID NO: 637 - DNA, 23 bp, Artificial Sequence
  Description of Artificial Sequence: Synthetic oligonucleotide
tgcacaccttggcgcagtggggg

SEQ ID NO: 638 - DNA, 22 bp, Artificial Sequence
  Description of Artificial Sequence: Synthetic oligonucleotide
ccagcacctggcacaggggagg

SEQ ID NO: 639 - DNA, 22 bp, Artificial Sequence
  Description of Artificial Sequence: Synthetic oligonucleotide
cccacaccaggcacagaggagg

SEQ ID NO: 640 - DNA, 23 bp, Artificial Sequence
  Description of Artificial Sequence: Synthetic oligonucleotide
gtagcacgttgacgcagcagcgg

SEQ ID NO: 641 - DNA, 22 bp, Artificial Sequence
  Description of Artificial Sequence: Synthetic oligonucleotide
gccgcaccgggcgcagttgggg

SEQ ID NO: 642 - DNA, 22 bp, Artificial Sequence
  Description of Artificial Sequence: Synthetic oligonucleotide
cccacacctgccccagaggtgg

SEQ ID NO: 643 - DNA, 22 bp, Artificial Sequence
  Description of Artificial Sequence: Synthetic oligonucleotide
cccacagctggcccagcagggg

SEQ ID NO: 644 - DNA, 23 bp, Artificial Sequence
  Description of Artificial Sequence: Synthetic oligonucleotide
tcagcaccttggcacagctgaag

SEQ ID NO: 645 - DNA, 23 bp, Artificial Sequence
  Description of Artificial Sequence: Synthetic oligonucleotide
acagcacctcggtgcagcagaga

SEQ ID NO: 646 - DNA, 22 bp, Artificial Sequence
  Description of Artificial Sequence: Synthetic oligonucleotide
ccctcccatggcgcagcttcgg

SEQ ID NO: 647 - DNA, 22 bp, Artificial Sequence
  Description of Artificial Sequence: Synthetic oligonucleotide
cccgcaccgggcgcagcagctg

SEQ ID NO: 648 - DNA, 23 bp, Artificial Sequence
  Description of Artificial Sequence: Synthetic oligonucleotide
catgctacatggcgcagcggtag

SEQ ID NO: 649 - DNA, 23 bp, Artificial Sequence
  Description of Artificial Sequence: Synthetic oligonucleotide
ctcgcacccgaacgcagcagagg

SEQ ID NO: 650 - DNA, 23 bp, Artificial Sequence
  Description of Artificial Sequence: Synthetic oligonucleotide
tccccaccccagcgcagcagagg

SEQ ID NO: 651 - DNA, 23 bp, Artificial Sequence
  Description of Artificial Sequence: Synthetic oligonucleotide
cgaagaccttggcgcagaagcgg

SEQ ID NO: 652 - DNA, 23 bp, Artificial Sequence
  Description of Artificial Sequence: Synthetic oligonucleotide
cccgcaccttggcctagcgcggt

SEQ ID NO: 653 - DNA, 23 bp, Artificial Sequence
  Description of Artificial Sequence: Synthetic oligonucleotide
tctgcaccttggcgcagctggag

SEQ ID NO: 654 - DNA, 23 bp, Artificial Sequence
  Description of Artificial Sequence: Synthetic oligonucleotide
ctcccaccttaaagcagcggtgg

SEQ ID NO: 655 - DNA, 22 bp, Artificial Sequence
  Description of Artificial Sequence: Synthetic oligonucleotide
accgcacctggcccagagtggg

SEQ ID NO: 656 - DNA, 23 bp, Artificial Sequence
  Description of Artificial Sequence: Synthetic oligonucleotide
cccccaccttggcccagcgttgg

SEQ ID NO: 657 - DNA, 22 bp, Artificial Sequence
  Description of Artificial Sequence: Synthetic oligonucleotide
gccacacctcgcacagcggtgg

SEQ ID NO: 658 - DNA, 23 bp, Artificial Sequence
  Description of Artificial Sequence: Synthetic oligonucleotide
accacaccttgctgcagaggagg

SEQ ID NO: 659 - DNA, 22 bp, Artificial Sequence
  Description of Artificial Sequence: Synthetic oligonucleotide
cccgcagagggcgcagcggctg

SEQ ID NO: 660 - DNA, 21 bp, Artificial Sequence
  Description of Artificial Sequence: Synthetic oligonucleotide
ccagcactggctcagcagagg

SEQ ID NO: 661 - DNA, 22 bp, Artificial Sequence
  Description of Artificial Sequence: Synthetic oligonucleotide
accgcacccggcccagtggagg

SEQ ID NO: 662 - DNA, 23 bp, Artificial Sequence
  Description of Artificial Sequence: Synthetic oligonucleotide
cctgcactcaggcgcagacgggg

SEQ ID NO: 663 - DNA, 23 bp, Artificial Sequence
  Description of Artificial Sequence: Synthetic oligonucleotide
gctgcaccttggcacagtggagg

SEQ ID NO: 664 - DNA, 23 bp, Artificial Sequence
  Description of Artificial Sequence: Synthetic oligonucleotide
cccacacccaggcccagaggagg

SEQ ID NO: 665 - DNA, 21 bp, Artificial Sequence
  Description of Artificial Sequence: Synthetic oligonucleotide
cctgcacctgcacagcagggg

SEQ ID NO: 666 - DNA, 22 bp, Artificial Sequence
  Description of Artificial Sequence: Synthetic oligonucleotide
ctcgcacctggtgcagcaccgg

SEQ ID NO: 667 - DNA, 21 bp, Artificial Sequence
  Description of Artificial Sequence: Synthetic oligonucleotide
gccgcacaggcacagcggcgg

SEQ ID NO: 668 - DNA, 23 bp, Artificial Sequence
  Description of Artificial Sequence: Synthetic oligonucleotide
tcagcaccttggcacatccaggg

SEQ ID NO: 669 - DNA, 23 bp, Artificial Sequence
  Description of Artificial Sequence: Synthetic oligonucleotide
cctgcacctttgcacagcactgg

SEQ ID NO: 670 - DNA, 22 bp, Artificial Sequence
  Description of Artificial Sequence: Synthetic oligonucleotide
cccgcatgtggcgcagcagtgt

SEQ ID NO: 671 - DNA, 23 bp, Artificial Sequence
  Description of Artificial Sequence: Synthetic oligonucleotide
cccagcacttggtgaagcggagg

SEQ ID NO: 672 - DNA, 21 bp, Artificial Sequence
  Description of Artificial Sequence: Synthetic oligonucleotide
cccacactggtgcagaggtgg

SEQ ID NO: 673 - DNA, 23 bp, Artificial Sequence
  Description of Artificial Sequence: Synthetic oligonucleotide
cctgcaccatggtgcaccggcag

SEQ ID NO: 674 - DNA, 21 bp, Artificial Sequence
  Description of Artificial Sequence: Synthetic oligonucleotide
cccgcacagccgcagaggagg

SEQ ID NO: 675 - DNA, 22 bp, Artificial Sequence
  Description of Artificial Sequence: Synthetic oligonucleotide
accgcacctggcacagcttggg

SEQ ID NO: 676 - DNA, 23 bp, Artificial Sequence
  Description of Artificial Sequence: Synthetic oligonucleotide
cccacaccctggcccagcctcgg

SEQ ID NO: 677 - DNA, 23 bp, Artificial Sequence
  Description of Artificial Sequence: Synthetic oligonucleotide
ccagcactttggtacagcatagg

SEQ ID NO: 678 - DNA, 23 bp, Artificial Sequence
  Description of Artificial Sequence: Synthetic oligonucleotide
cccgcaccctggctcagtgttgg

SEQ ID NO: 679 - DNA, 21 bp, Artificial Sequence
  Description of Artificial Sequence: Synthetic oligonucleotide
cccgcacaggcgcagaggtgg

SEQ ID NO: 680 - DNA, 22 bp, Artificial Sequence
  Description of Artificial Sequence: Synthetic oligonucleotide
ccagcacctggtccagtggagg

SEQ ID NO: 681 - DNA, 22 bp, Artificial Sequence
  Description of Artificial Sequence: Synthetic oligonucleotide
ccagcacctggcacagagtagg

SEQ ID NO: 682 - DNA, 23 bp, Artificial Sequence
  Description of Artificial Sequence: Synthetic oligonucleotide
cagataccataaaaatcatctgg

SEQ ID NO: 683 - DNA, 22 bp, Artificial Sequence
  Description of Artificial Sequence: Synthetic oligonucleotide
aagatactgaaaaaccctgcaa

SEQ ID NO: 684 - DNA, 23 bp, Artificial Sequence
  Description of Artificial Sequence: Synthetic oligonucleotide
cagagagcagagtaaacctctgg

SEQ ID NO: 685 - DNA, 21 bp, Artificial Sequence
  Description of Artificial Sequence: Synthetic oligonucleotide
cagaaaactataaccctcagg

SEQ ID NO: 686 - DNA, 23 bp, Artificial Sequence
  Description of Artificial Sequence: Synthetic oligonucleotide
agaatggctgcataacccttggg

SEQ ID NO: 687 - DNA, 23 bp, Artificial Sequence
  Description of Artificial Sequence: Synthetic oligonucleotide
aaggttacttaataaacatctgg

SEQ ID NO: 688 - DNA, 24 bp, Artificial Sequence
  Description of Artificial Sequence: Synthetic oligonucleotide
aagatacctgaattaaatctcaaa

SEQ ID NO: 689 - DNA, 23 bp, Artificial Sequence
  Description of Artificial Sequence: Synthetic oligonucleotide
aagtatcttgaataaccctcctg

SEQ ID NO: 690 - DNA, 23 bp, Artificial Sequence
  Description of Artificial Sequence: Synthetic oligonucleotide
caaataactaaatgaccctcttg

SEQ ID NO: 691 - DNA, 22 bp, Artificial Sequence
  Description of Artificial Sequence: Synthetic oligonucleotide
aagatactgaaaaactctcttc

SEQ ID NO: 692 - DNA, 24 bp, Artificial Sequence
  Description of Artificial Sequence: Synthetic oligonucleotide
tagataacctgaatagccctatag

SEQ ID NO: 693 - DNA, 23 bp, Artificial Sequence
  Description of Artificial Sequence: Synthetic oligonucleotide
tagatacttcaatacctctcagt

SEQ ID NO: 694 - DNA, 23 bp, Artificial Sequence
  Description of Artificial Sequence: Synthetic oligonucleotide
agcaatcctgaaaaatcctctgg

SEQ ID NO: 695 - DNA, 23 bp, Artificial Sequence
  Description of Artificial Sequence: Synthetic oligonucleotide
acgatacttggataaccctctgg

SEQ ID NO: 696 - DNA, 22 bp, Artificial Sequence
  Description of Artificial Sequence: Synthetic oligonucleotide
gagatacctaataagcctctat

SEQ ID NO: 697 - DNA, 23 bp, Artificial Sequence
  Description of Artificial Sequence: Synthetic oligonucleotide
aagatacctgaataaccctctgg

SEQ ID NO: 698 - DNA, 22 bp, Artificial Sequence
  Description of Artificial Sequence: Synthetic oligonucleotide
aagttactgaatatctctcagc

SEQ ID NO: 699 - DNA, 23 bp, Artificial Sequence
  Description of Artificial Sequence: Synthetic oligonucleotide
agtatacctcaataaccacctgg

SEQ ID NO: 700 - DNA, 22 bp, Artificial Sequence
  Description of Artificial Sequence: Synthetic oligonucleotide
aagatccagaagaatcccctgg

SEQ ID NO: 701 - DNA, 23 bp, Artificial Sequence
  Description of Artificial Sequence: Synthetic oligonucleotide
aggatacctggaaaccctactgg

SEQ ID NO: 702 - DNA, 23 bp, Artificial Sequence
  Description of Artificial Sequence: Synthetic oligonucleotide
aagataactagctagctctctgg

SEQ ID NO: 703 - DNA, 23 bp, Artificial Sequence
  Description of Artificial Sequence: Synthetic oligonucleotide
gagatacttgaataaacttctat

SEQ ID NO: 704 - DNA, 23 bp, Artificial Sequence
  Description of Artificial Sequence: Synthetic oligonucleotide
aagatacctgactaacctgtttt

SEQ ID NO: 705 - DNA, 23 bp, Artificial Sequence
  Description of Artificial Sequence: Synthetic oligonucleotide
tagatacatgattaaaccactgc

SEQ ID NO: 706 - DNA, 21 bp, Artificial Sequence
  Description of Artificial Sequence: Synthetic oligonucleotide
tatatacatgaataactccgg

SEQ ID NO: 707 - DNA, 23 bp, Artificial Sequence
  Description of Artificial Sequence: Synthetic oligonucleotide
attattcttgaataaccccaggg

SEQ ID NO: 708 - DNA, 23 bp, Artificial Sequence
  Description of Artificial Sequence: Synthetic oligonucleotide
aagatacctgagaaactctgcaa

SEQ ID NO: 709 - DNA, 23 bp, Artificial Sequence
  Description of Artificial Sequence: Synthetic oligonucleotide
atgactgctgagaaaccctctgg

SEQ ID NO: 710 - DNA, 23 bp, Artificial Sequence
  Description of Artificial Sequence: Synthetic oligonucleotide
aagaatcctagatatccctcagt

SEQ ID NO: 711 - DNA, 23 bp, Artificial Sequence
  Description of Artificial Sequence: Synthetic oligonucleotide
aaaataccaaaaaaaccctatag

SEQ ID NO: 712 - DNA, 22 bp, Artificial Sequence
  Description of Artificial Sequence: Synthetic oligonucleotide
aagaatttgaataaccctcaat

SEQ ID NO: 713 - DNA, 23 bp, Artificial Sequence
  Description of Artificial Sequence: Synthetic oligonucleotide
aggctaacagaatcaccctcggg

SEQ ID NO: 714 - DNA, 22 bp, Artificial Sequence
  Description of Artificial Sequence: Synthetic oligonucleotide
gtgatcctgagtaaacctcagg

SEQ ID NO: 715 - DNA, 21 bp, Artificial Sequence
  Description of Artificial Sequence: Synthetic oligonucleotide
tagatacctataagcctctgg

SEQ ID NO: 716 - DNA, 23 bp, Artificial Sequence
  Description of Artificial Sequence: Synthetic oligonucleotide
aagatacatgaaaaaaacattgg

SEQ ID NO: 717 - DNA, 23 bp, Artificial Sequence
  Description of Artificial Sequence: Synthetic oligonucleotide
aagataccttaaaacccttcagc

SEQ ID NO: 718 - DNA, 23 bp, Artificial Sequence
  Description of Artificial Sequence: Synthetic oligonucleotide
aatttacctgaatagtcattagg

SEQ ID NO: 719 - DNA, 23 bp, Artificial Sequence
  Description of Artificial Sequence: Synthetic oligonucleotide
aagatacacaaatagccatcaag

SEQ ID NO: 720 - DNA, 23 bp, Artificial Sequence
  Description of Artificial Sequence: Synthetic oligonucleotide
aacaaacctgaatagtcctactg

SEQ ID NO: 721 - DNA, 23 bp, Artificial Sequence
  Description of Artificial Sequence: Synthetic oligonucleotide
cagatatctgaatcactcttctg

SEQ ID NO: 722 - DNA, 21 bp, Artificial Sequence
  Description of Artificial Sequence: Synthetic oligonucleotide
aaaatatgaataaccctttgg

SEQ ID NO: 723 - DNA, 22 bp, Artificial Sequence
  Description of Artificial Sequence: Synthetic oligonucleotide
cagatactgagtcaccctcagc

SEQ ID NO: 724 - DNA, 22 bp, Artificial Sequence
  Description of Artificial Sequence: Synthetic oligonucleotide
aagtacctaaatacccttgggg

SEQ ID NO: 725 - DNA, 23 bp, Artificial Sequence
  Description of Artificial Sequence: Synthetic oligonucleotide
aagataccattctaaccctctga

SEQ ID NO: 726 - DNA, 23 bp, Artificial Sequence
  Description of Artificial Sequence: Synthetic oligonucleotide
aaggtaactaagaaaccctcaga

SEQ ID NO: 727 - DNA, 23 bp, Artificial Sequence
  Description of Artificial Sequence: Synthetic oligonucleotide
ctcataccacaataaccctcatg

SEQ ID NO: 728 - DNA, 22 bp, Artificial Sequence
  Description of Artificial Sequence: Synthetic oligonucleotide
aagataatgaatatcacccagg

SEQ ID NO: 729 - DNA, 22 bp, Artificial Sequence
  Description of Artificial Sequence: Synthetic oligonucleotide
aagatactaataaacactcagg

SEQ ID NO: 730 - DNA, 23 bp, Artificial Sequence
  Description of Artificial Sequence: Synthetic oligonucleotide
cagatacctgaataagcagaagc

SEQ ID NO: 731 - DNA, 22 bp, Artificial Sequence
  Description of Artificial Sequence: Synthetic oligonucleotide
ataatacctgaatactctcaga

SEQ ID NO: 732 - DNA, 23 bp, Artificial Sequence
  Description of Artificial Sequence: Synthetic oligonucleotide
tctatacctgcataaccctaagg

SEQ ID NO: 733 - DNA, 23 bp, Artificial Sequence
  Description of Artificial Sequence: Synthetic oligonucleotide
aagttaccaggaggaccctcagg

SEQ ID NO: 734 - DNA, 23 bp, Artificial Sequence
  Description of Artificial Sequence: Synthetic oligonucleotide
aagagaccggaatgcccccttgg

SEQ ID NO: 735 - DNA, 23 bp, Artificial Sequence
  Description of Artificial Sequence: Synthetic oligonucleotide
aacaggccataagaaccctctgg

SEQ ID NO: 736 - DNA, 23 bp, Artificial Sequence
  Description of Artificial Sequence: Synthetic oligonucleotide
taaatgccaggataagcctctgg

SEQ ID NO: 737 - DNA, 23 bp, Artificial Sequence
  Description of Artificial Sequence: Synthetic oligonucleotide
tacataactgaataactctccaa

SEQ ID NO: 738 - DNA, 22 bp, Artificial Sequence
  Description of Artificial Sequence: Synthetic oligonucleotide
aagaaagctgagtaagcccggg

SEQ ID NO: 739 - DNA, 23 bp, Artificial Sequence
  Description of Artificial Sequence: Synthetic oligonucleotide
gggatacccgaataaccccacag

SEQ ID NO: 740 - DNA, 22 bp, Artificial Sequence
  Description of Artificial Sequence: Synthetic oligonucleotide
gagacacctgggtaaccccagg

SEQ ID NO: 741 - DNA, 23 bp, Artificial Sequence
  Description of Artificial Sequence: Synthetic oligonucleotide
gttatacctgaataaatctgggg

SEQ ID NO: 742 - DNA, 23 bp, Artificial Sequence
  Description of Artificial Sequence: Synthetic oligonucleotide
aaaatacctgcataaccctgaga

SEQ ID NO: 743 - DNA, 23 bp, Artificial Sequence
  Description of Artificial Sequence: Synthetic oligonucleotide
cagttccctgagtcaccctcagt

SEQ ID NO: 744 - DNA, 23 bp, Artificial Sequence
  Description of Artificial Sequence: Synthetic oligonucleotide
aagatacatgaacttcccacagg

SEQ ID NO: 745 - DNA, 23 bp, Artificial Sequence
  Description of Artificial Sequence: Synthetic oligonucleotide
aaaataagtgaataacccactaa

SEQ ID NO: 746 - DNA, 23 bp, Artificial Sequence
  Description of Artificial Sequence: Synthetic oligonucleotide
taggtacctgagtaactctgcgg

SEQ ID NO: 747 - DNA, 22 bp, Artificial Sequence
  Description of Artificial Sequence: Synthetic oligonucleotide
aagaaaccagataacccacagc

SEQ ID NO: 748 - DNA, 22 bp, Artificial Sequence
  Description of Artificial Sequence: Synthetic oligonucleotide
aagatacctgcataatctagga

SEQ ID NO: 749 - DNA, 23 bp, Artificial Sequence
  Description of Artificial Sequence: Synthetic oligonucleotide
aggatacctgcgtaactcgcagc

SEQ ID NO: 750 - DNA, 23 bp, Artificial Sequence
  Description of Artificial Sequence: Synthetic oligonucleotide
aagatacctggagatgccccttg

SEQ ID NO: 751 - DNA, 23 bp, Artificial Sequence
  Description of Artificial Sequence: Synthetic oligonucleotide
aagatatcagaataactctggct

SEQ ID NO: 752 - DNA, 23 bp, Artificial Sequence
  Description of Artificial Sequence: Synthetic oligonucleotide
cctgtacctgcataaccttctgg

SEQ ID NO: 753 - DNA, 23 bp, Artificial Sequence
  Description of Artificial Sequence: Synthetic oligonucleotide
aagatacctaaaaagcccccagc

SEQ ID NO: 754 - DNA, 24 bp, Artificial Sequence
  Description of Artificial Sequence: Synthetic oligonucleotide
tagatacccaaatagcccctcagg

SEQ ID NO: 755 - DNA, 23 bp, Artificial Sequence
  Description of Artificial Sequence: Synthetic oligonucleotide
tctatacctaaatagtcctcagg

SEQ ID NO: 756 - DNA, 23 bp, Artificial Sequence
  Description of Artificial Sequence: Synthetic oligonucleotide
aaaataccagaataacccattta

SEQ ID NO: 757 - DNA, 23 bp, Artificial Sequence
  Description of Artificial Sequence: Synthetic oligonucleotide
aagatatctgaataaactccaaa

SEQ ID NO: 758 - DNA, 23 bp, Artificial Sequence
  Description of Artificial Sequence: Synthetic oligonucleotide
atgattattaaataaccctcaag

SEQ ID NO: 759 - DNA, 23 bp, Artificial Sequence
  Description of Artificial Sequence: Synthetic oligonucleotide
aagatccctgattaccattccag

SEQ ID NO: 760 - DNA, 23 bp, Artificial Sequence
  Description of Artificial Sequence: Synthetic oligonucleotide
aagatacctggctcaacctcatc

SEQ ID NO: 761 - DNA, 23 bp, Artificial Sequence
  Description of Artificial Sequence: Synthetic oligonucleotide
aatgtggctgaaaaagcctctgg

SEQ ID NO: 762 - DNA, 23 bp, Artificial Sequence
  Description of Artificial Sequence: Synthetic oligonucleotide
aagatacctaaacattccagtgg

SEQ ID NO: 763 - DNA, 23 bp, Artificial Sequence
  Description of Artificial Sequence: Synthetic oligonucleotide
aagagagctggacaactctaagg

SEQ ID NO: 764 - DNA, 23 bp, Artificial Sequence
  Description of Artificial Sequence: Synthetic oligonucleotide
aagataggtcaataaccacccgg

SEQ ID NO: 765 - DNA, 24 bp, Artificial Sequence
  Description of Artificial Sequence: Synthetic oligonucleotide
tagataactgaataaactctatgg

SEQ ID NO: 766 - DNA, 23 bp, Artificial Sequence
  Description of Artificial Sequence: Synthetic oligonucleotide
aagatgtattattgaccctctgg

SEQ ID NO: 767 - DNA, 23 bp, Artificial Sequence
  Description of Artificial Sequence: Synthetic oligonucleotide
tagaaaacagaatgactctcagg

SEQ ID NO: 768 - DNA, 22 bp, Artificial Sequence
  Description of Artificial Sequence: Synthetic oligonucleotide
aataaccaaaataaccctccag

SEQ ID NO: 769 - DNA, 22 bp, Artificial Sequence
  Description of Artificial Sequence: Synthetic oligonucleotide
tatgtacctaataagcctcagg

SEQ ID NO: 770 - DNA, 23 bp, Artificial Sequence
  Description of Artificial Sequence: Synthetic oligonucleotide
catatatctgaatagccttctgg

SEQ ID NO: 771 - DNA, 22 bp, Artificial Sequence
  Description of Artificial Sequence: Synthetic oligonucleotide
aagatacagaattcccctctga

SEQ ID NO: 772 - DNA, 22 bp, Artificial Sequence
  Description of Artificial Sequence: Synthetic oligonucleotide
aagttacatgaaaaacatctgg

SEQ ID NO: 773 - DNA, 23 bp, Artificial Sequence
  Description of Artificial Sequence: Synthetic oligonucleotide
aaaatacctgaataatcctcgaa

SEQ ID NO: 774 - DNA, 23 bp, Artificial Sequence
  Description of Artificial Sequence: Synthetic oligonucleotide
aagataccagagaaagtctcaga

SEQ ID NO: 775 - DNA, 23 bp, Artificial Sequence
  Description of Artificial Sequence: Synthetic oligonucleotide
caaataccagaataccctacagg

SEQ ID NO: 776 - DNA, 22 bp, Artificial Sequence
  Description of Artificial Sequence: Synthetic oligonucleotide
atgatcctaaataaccttccag

SEQ ID NO: 777 - DNA, 22 bp, Artificial Sequence
  Description of Artificial Sequence: Synthetic oligonucleotide
aacaacatgaatgactctctgg

SEQ ID NO: 778 - DNA, 23 bp, Artificial Sequence
  Description of Artificial Sequence: Synthetic oligonucleotide
aagataaaggtatctccctctgg

SEQ ID NO: 779 - DNA, 23 bp, Artificial Sequence
  Description of Artificial Sequence: Synthetic oligonucleotide
aagccaactgaataacactgttg

SEQ ID NO: 780 - DNA, 23 bp, Artificial Sequence
  Description of Artificial Sequence: Synthetic oligonucleotide
atgatacctgaatacctctaatg

SEQ ID NO: 781 - DNA, 23 bp, Artificial Sequence
  Description of Artificial Sequence: Synthetic oligonucleotide
aagccaactgaagagcccttggg

SEQ ID NO: 782 - DNA, 22 bp, Artificial Sequence
  Description of Artificial Sequence: Synthetic oligonucleotide
aagaacttgataaaccctcaag

SEQ ID NO: 783 - DNA, 23 bp, Artificial Sequence
  Description of Artificial Sequence: Synthetic oligonucleotide
ttgacacctaaataaccctttgg

SEQ ID NO: 784 - DNA, 23 bp, Artificial Sequence
  Description of Artificial Sequence: Synthetic oligonucleotide
aagagaccagaagcaacctctgt

SEQ ID NO: 785 - DNA, 24 bp, Artificial Sequence
  Description of Artificial Sequence: Synthetic oligonucleotide
aagaaacatgaacagagcctcagg

SEQ ID NO: 786 - DNA, 23 bp, Artificial Sequence
  Description of Artificial Sequence: Synthetic oligonucleotide
gagatacctgtataagtcactag

SEQ ID NO: 787 - DNA, 23 bp, Artificial Sequence
  Description of Artificial Sequence: Synthetic oligonucleotide
aaaatgccttaagaaccctgggg

SEQ ID NO: 788 - DNA, 22 bp, Artificial Sequence
  Description of Artificial Sequence: Synthetic oligonucleotide
tagatactcagtaaccctcttg

SEQ ID NO: 789 - DNA, 23 bp, Artificial Sequence
  Description of Artificial Sequence: Synthetic oligonucleotide
aagagacaggaataaccctcagc

SEQ ID NO: 790 - DNA, 24 bp, Artificial Sequence
  Description of Artificial Sequence: Synthetic oligonucleotide
aaaataccatgtaaaacactctgg

SEQ ID NO: 791 - DNA, 22 bp, Artificial Sequence
  Description of Artificial Sequence: Synthetic oligonucleotide
gagatacagaatagccctgggg

SEQ ID NO: 792 - DNA, 22 bp, Artificial Sequence
  Description of Artificial Sequence: Synthetic oligonucleotide
aagaacctaaatcaccattggg

SEQ ID NO: 793 - DNA, 23 bp, Artificial Sequence
  Description of Artificial Sequence: Synthetic oligonucleotide
aagatatctggataatccaccaa

SEQ ID NO: 794 - DNA, 23 bp, Artificial Sequence
  Description of Artificial Sequence: Synthetic oligonucleotide
aagatactggaataaacataaag

SEQ ID NO: 795 - DNA, 23 bp, Artificial Sequence
  Description of Artificial Sequence: Synthetic oligonucleotide
aaaatgcctcaatatctctgtgg

SEQ ID NO: 796 - DNA, 23 bp, Artificial Sequence
  Description of Artificial Sequence: Synthetic oligonucleotide
aaaataccaaaataaccctaaag

SEQ ID NO: 797 - DNA, 23 bp, Artificial Sequence
  Description of Artificial Sequence: Synthetic oligonucleotide
tagatacctgaaatactctatgc

SEQ ID NO: 798 - DNA, 23 bp, Artificial Sequence
  Description of Artificial Sequence: Synthetic oligonucleotide
aaaataccataatttccctcaga

SEQ ID NO: 799 - DNA, 22 bp, Artificial Sequence
  Description of Artificial Sequence: Synthetic oligonucleotide
aagataccaaataaacctctga

SEQ ID NO: 800 - DNA, 23 bp, Artificial Sequence
  Description of Artificial Sequence: Synthetic oligonucleotide
aagatacctaaaatacctattgg

SEQ ID NO: 801 - DNA, 23 bp, Artificial Sequence
  Description of Artificial Sequence: Synthetic oligonucleotide
cagatacctgaaaaactctctct

SEQ ID NO: 802 - DNA, 24 bp, Artificial Sequence
  Description of Artificial Sequence: Synthetic oligonucleotide
aataaacactgaataaccctttgt

SEQ ID NO: 803 - DNA, 22 bp, Artificial Sequence
  Description of Artificial Sequence: Synthetic oligonucleotide
cagctacctaattaccctctgg

SEQ ID NO: 804 - DNA, 23 bp, Artificial Sequence
  Description of Artificial Sequence: Synthetic oligonucleotide
taggtacctgatttaccctgatg

SEQ ID NO: 805 - DNA, 23 bp, Artificial Sequence
  Description of Artificial Sequence: Synthetic oligonucleotide
aagatacctcaggaaccagcagc

SEQ ID NO: 806 - DNA, 23 bp, Artificial Sequence
  Description of Artificial Sequence: Synthetic oligonucleotide
aaaagacctaaaaagccctctgg

SEQ ID NO: 807 - DNA, 23 bp, Artificial Sequence
  Description of Artificial Sequence: Synthetic oligonucleotide
tcaattactgaataaccctcttg

SEQ ID NO: 808 - DNA, 23 bp, Artificial Sequence
  Description of Artificial Sequence: Synthetic oligonucleotide
aatatacatgaataaatctcaca

SEQ ID NO: 809 - DNA, 23 bp, Artificial Sequence
  Description of Artificial Sequence: Synthetic oligonucleotide
aaaaaacgtgaaaaaccttaggg

SEQ ID NO: 810 - DNA, 22 bp, Artificial Sequence
  Description of Artificial Sequence: Synthetic oligonucleotide
aagatacctgttagccctcacc

SEQ ID NO: 811 - DNA, 23 bp, Artificial Sequence
  Description of Artificial Sequence: Synthetic oligonucleotide
aagtttcatgcataaaactctgg

SEQ ID NO: 812 - DNA, 23 bp, Artificial Sequence
  Description of Artificial Sequence: Synthetic oligonucleotide
aaggtacctgaagaactcaactg

SEQ ID NO: 813 - DNA, 23 bp, Artificial Sequence
  Description of Artificial Sequence: Synthetic oligonucleotide
aagatgtatgaataactctcggg

SEQ ID NO: 814 - DNA, 23 bp, Artificial Sequence
  Description of Artificial Sequence: Synthetic oligonucleotide
aagcaacctaaatgtccatcagg

SEQ ID NO: 815 - DNA, 23 bp, Artificial Sequence
  Description of Artificial Sequence: Synthetic oligonucleotide
gagatacctggataaccacttgg

SEQ ID NO: 816 - DNA, 23 bp, Artificial Sequence
  Description of Artificial Sequence: Synthetic oligonucleotide
aagacacctggagaactctcggg

SEQ ID NO: 817 - DNA, 22 bp, Artificial Sequence
  Description of Artificial Sequence: Synthetic oligonucleotide
aagtaacccaataaccctgagg

SEQ ID NO: 818 - DNA, 24 bp, Artificial Sequence
  Description of Artificial Sequence: Synthetic oligonucleotide
acaatacgtgaatgaatcctctgg

SEQ ID NO: 819 - DNA, 23 bp, Artificial Sequence
  Description of Artificial Sequence: Synthetic oligonucleotide
aagattccagacatacactctgg

SEQ ID NO: 820 - DNA, 23 bp, Artificial Sequence
  Description of Artificial Sequence: Synthetic oligonucleotide
taagtagctgtataaccctgggg

SEQ ID NO: 821 - DNA, 23 bp, Artificial Sequence
  Description of Artificial Sequence: Synthetic oligonucleotide
taaatacttgaaaaacccacaga

SEQ ID NO: 822 - DNA, 23 bp, Artificial Sequence
  Description of Artificial Sequence: Synthetic oligonucleotide
aagttatctgactaacaatctgt

SEQ ID NO: 823 - DNA, 23 bp, Artificial Sequence
  Description of Artificial Sequence: Synthetic oligonucleotide
aatatacatgaatttctcttagg

SEQ ID NO: 824 - DNA, 23 bp, Artificial Sequence
  Description of Artificial Sequence: Synthetic oligonucleotide
aagatgcctccctaacactgggg

SEQ ID NO: 825 - DNA, 21 bp, Artificial Sequence
  Description of Artificial Sequence: Synthetic oligonucleotide
tacataccaacaaccctctgg

SEQ ID NO: 826 - DNA, 23 bp, Artificial Sequence
  Description of Artificial Sequence: Synthetic oligonucleotide
aatagagctgaaaaaccctcact

SEQ ID NO: 827 - DNA, 23 bp, Artificial Sequence
  Description of Artificial Sequence: Synthetic oligonucleotide
aaattagatgaataacccttagt

SEQ ID NO: 828 - DNA, 21 bp, Artificial Sequence
  Description of Artificial Sequence: Synthetic oligonucleotide
aaaatacctgataccccctgg

SEQ ID NO: 829 - DNA, 21 bp, Artificial Sequence
  Description of Artificial Sequence: Synthetic oligonucleotide
agagtacctgaatacctctgg

SEQ ID NO: 830 - DNA, 23 bp, Artificial Sequence
  Description of Artificial Sequence: Synthetic oligonucleotide
agaatatctgaattaccctcaag

SEQ ID NO: 831 - DNA, 22 bp, Artificial Sequence
  Description of Artificial Sequence: Synthetic oligonucleotide
aagatacatgagtaaacccagc

SEQ ID NO: 832 - DNA, 23 bp, Artificial Sequence
  Description of Artificial Sequence: Synthetic oligonucleotide
aggagacctgcacaggcctctgg

SEQ ID NO: 833 - DNA, 23 bp, Artificial Sequence
  Description of Artificial Sequence: Synthetic oligonucleotide
aatttatatgaaaaacccactgg

SEQ ID NO: 834 - DNA, 23 bp, Artificial Sequence
  Description of Artificial Sequence: Synthetic oligonucleotide
aagatacctgatcaatcctcttc

SEQ ID NO: 835 - DNA, 23 bp, Artificial Sequence
  Description of Artificial Sequence: Synthetic oligonucleotide
aagataccagaccaaagctcagg

SEQ ID NO: 836 - DNA, 23 bp, Artificial Sequence
  Description of Artificial Sequence: Synthetic oligonucleotide
tagagacatgaaaaaccctccaa

SEQ ID NO: 837 - DNA, 21 bp, Artificial Sequence
  Description of Artificial Sequence: Synthetic oligonucleotide
aatattcctgaatccctcggg

SEQ ID NO: 838 - DNA, 23 bp, Artificial Sequence
  Description of Artificial Sequence: Synthetic oligonucleotide
ctcatacctgaataaccttctca

SEQ ID NO: 839 - DNA, 24 bp, Artificial Sequence
  Description of Artificial Sequence: Synthetic oligonucleotide
cagataccgagaaaaaccctctgg

SEQ ID NO: 840 - DNA, 23 bp, Artificial Sequence
  Description of Artificial Sequence: Synthetic oligonucleotide
aagatatatgaaaaagcctatgc

SEQ ID NO: 841 - DNA, 23 bp, Artificial Sequence
  Description of Artificial Sequence: Synthetic oligonucleotide
cagatacctcaccaacactccag

SEQ ID NO: 842 - DNA, 23 bp, Artificial Sequence
  Description of Artificial Sequence: Synthetic oligonucleotide
cagagacctgaaaagccctgccg

SEQ ID NO: 843 - DNA, 23 bp, Artificial Sequence
  Description of Artificial Sequence: Synthetic oligonucleotide
aaaaggcctgcagaaacctctgg

SEQ ID NO: 844 - DNA, 23 bp, Artificial Sequence
  Description of Artificial Sequence: Synthetic oligonucleotide
caaatccttgaatcacccccagg

SEQ ID NO: 845 - DNA, 23 bp, Artificial Sequence
  Description of Artificial Sequence: Synthetic oligonucleotide
aagatacctggccacaccccagg

SEQ ID NO: 846 - DNA, 22 bp, Artificial Sequence
  Description of Artificial Sequence: Synthetic oligonucleotide
gagataatgaatagccctccgg

SEQ ID NO: 847 - DNA, 22 bp, Artificial Sequence
  Description of Artificial Sequence: Synthetic oligonucleotide
aagatacctgtcatccctccgt

SEQ ID NO: 848 - DNA, 23 bp, Artificial Sequence
  Description of Artificial Sequence: Synthetic oligonucleotide
gggatacctgcataactctcagg

SEQ ID NO: 849 - DNA, 23 bp, Artificial Sequence
  Description of Artificial Sequence: Synthetic oligonucleotide
gaaatgcctgaatcacactcgag

SEQ ID NO: 850 - DNA, 22 bp, Artificial Sequence
  Description of Artificial Sequence: Synthetic oligonucleotide
aagatactgaatcaacttcagt

SEQ ID NO: 851 - DNA, 22 bp, Artificial Sequence
  Description of Artificial Sequence: Synthetic oligonucleotide
aagataccagtacacccccagg

SEQ ID NO: 852 - DNA, 23 bp, Artificial Sequence
  Description of Artificial Sequence: Synthetic oligonucleotide
atgatacctcaataaccctattt

SEQ ID NO: 853 - DNA, 23 bp, Artificial Sequence
  Description of Artificial Sequence: Synthetic oligonucleotide
aaaatacctgaacataccttgag

SEQ ID NO: 854 - DNA, 23 bp, Artificial Sequence
  Description of Artificial Sequence: Synthetic oligonucleotide
tacatacctaacaacccctcagg

SEQ ID NO: 855 - DNA, 23 bp, Artificial Sequence
  Description of Artificial Sequence: Synthetic oligonucleotide
aagaaacaagggaaaccctcagg

SEQ ID NO: 856 - DNA, 23 bp, Artificial Sequence
  Description of Artificial Sequence: Synthetic oligonucleotide
aagataccaggatggctctctgc

SEQ ID NO: 857 - DNA, 23 bp, Artificial Sequence
  Description of Artificial Sequence: Synthetic oligonucleotide
caacaaccagaataacccacagg

SEQ ID NO: 858 - DNA, 24 bp, Artificial Sequence
  Description of Artificial Sequence: Synthetic oligonucleotide
aagattaaaagaataaacctcagg

SEQ ID NO: 859 - DNA, 23 bp, Artificial Sequence
  Description of Artificial Sequence: Synthetic oligonucleotide
aacttacctgcaaaaccatctgg

SEQ ID NO: 860 - DNA, 21 bp, Artificial Sequence
  Description of Artificial Sequence: Synthetic oligonucleotide
aagatctgaattaccatcagt

SEQ ID NO: 861 - DNA, 22 bp, Artificial Sequence
  Description of Artificial Sequence: Synthetic oligonucleotide
gagatccttaacaaccctcaag

SEQ ID NO: 862 - DNA, 23 bp, Artificial Sequence
  Description of Artificial Sequence: Synthetic oligonucleotide
aagatatctgagccacactctcg

SEQ ID NO: 863 - DNA, 22 bp, Artificial Sequence
  Description of Artificial Sequence: Synthetic oligonucleotide
aagctacctgaaaaccttcagg

SEQ ID NO: 864 - DNA, 23 bp, Artificial Sequence
  Description of Artificial Sequence: Synthetic oligonucleotide
aagatgactgaagaaaccttggg

SEQ ID NO: 865 - DNA, 23 bp, Artificial Sequence
  Description of Artificial Sequence: Synthetic oligonucleotide
aagatccctgcaaacccttttgg

SEQ ID NO: 866 - DNA, 23 bp, Artificial Sequence
  Description of Artificial Sequence: Synthetic oligonucleotide
aagacagctaaatcaccccacgg

SEQ ID NO: 867 - DNA, 23 bp, Artificial Sequence
  Description of Artificial Sequence: Synthetic oligonucleotide
aagatcacagaatcaccctcctc

SEQ ID NO: 868 - DNA, 23 bp, Artificial Sequence
  Description of Artificial Sequence: Synthetic oligonucleotide
aatagacatgaataaccctaaga

SEQ ID NO: 869 - DNA, 23 bp, Artificial Sequence
  Description of Artificial Sequence: Synthetic oligonucleotide
cagacaccttactaactctcctg

SEQ ID NO: 870 - DNA, 23 bp, Artificial Sequence
  Description of Artificial Sequence: Synthetic oligonucleotide
aagatacacaaataaacttctag

SEQ ID NO: 871 - DNA, 23 bp, Artificial Sequence
  Description of Artificial Sequence: Synthetic oligonucleotide
aagatatctgaaaaactctcaaa

SEQ ID NO: 872 - DNA, 22 bp, Artificial Sequence
  Description of Artificial Sequence: Synthetic oligonucleotide
aagacactgaataacccacaga

SEQ ID NO: 873 - DNA, 22 bp, Artificial Sequence
  Description of Artificial Sequence: Synthetic oligonucleotide
tagatagcaaataaccctaggg

SEQ ID NO: 874 - DNA, 22 bp, Artificial Sequence
  Description of Artificial Sequence: Synthetic oligonucleotide
aatagacctaaataacctcaag

SEQ ID NO: 875 - DNA, 23 bp, Artificial Sequence
  Description of Artificial Sequence: Synthetic oligonucleotide
aagttacctgactaaccctgagg

SEQ ID NO: 876 - DNA, 23 bp, Artificial Sequence
  Description of Artificial Sequence: Synthetic oligonucleotide
aagatatctgaataactacaagg

SEQ ID NO: 877 - DNA, 23 bp, Artificial Sequence
  Description of Artificial Sequence: Synthetic oligonucleotide
aagatacttggataactctgcta

SEQ ID NO: 878 - DNA, 23 bp, Artificial Sequence
  Description of Artificial Sequence: Synthetic oligonucleotide
aagaggctggaataagccacggg

SEQ ID NO: 879 - DNA, 23 bp, Artificial Sequence
  Description of Artificial Sequence: Synthetic oligonucleotide
aagatacataaatatcactgcag

SEQ ID NO: 880 - DNA, 23 bp, Artificial Sequence
  Description of Artificial Sequence: Synthetic oligonucleotide
cactaacctgaatagccctaagg

SEQ ID NO: 881 - DNA, 23 bp, Artificial Sequence
  Description of Artificial Sequence: Synthetic oligonucleotide
aatatacctgaaaaaccatcagg

SEQ ID NO: 882 - DNA, 23 bp, Artificial Sequence
  Description of Artificial Sequence: Synthetic oligonucleotide
aaaatacctaaagaaatttcagg

SEQ ID NO: 883 - DNA, 23 bp, Artificial Sequence
  Description of Artificial Sequence: Synthetic oligonucleotide
cgtgtacctgaaaaagcctcagg

SEQ ID NO: 884 - DNA, 23 bp, Artificial Sequence
  Description of Artificial Sequence: Synthetic oligonucleotide
gtgaggcctgaagaacactctgg

SEQ ID NO: 885 - DNA, 22 bp, Artificial Sequence
  Description of Artificial Sequence: Synthetic oligonucleotide
aagttactgaatatccctccag

SEQ ID NO: 886 - DNA, 23 bp, Artificial Sequence
  Description of Artificial Sequence: Synthetic oligonucleotide
aagaaaccggaatgagcccccag

SEQ ID NO: 887 - DNA, 23 bp, Artificial Sequence
  Description of Artificial Sequence: Synthetic oligonucleotide
cagataccagaagcaccctcgag

SEQ ID NO: 888 - DNA, 24 bp, Artificial Sequence
  Description of Artificial Sequence: Synthetic oligonucleotide
tagataactgaaatatccctctgg

SEQ ID NO: 889 - DNA, 23 bp, Artificial Sequence
  Description of Artificial Sequence: Synthetic oligonucleotide
gagatacccaaataaacctcaaa

SEQ ID NO: 890 - DNA, 22 bp, Artificial Sequence
  Description of Artificial Sequence: Synthetic oligonucleotide
aagatactgaataaagctctta

SEQ ID NO: 891 - DNA, 23 bp, Artificial Sequence
  Description of Artificial Sequence: Synthetic oligonucleotide
aagataactgaagaaactgaagg

SEQ ID NO: 892 - DNA, 23 bp, Artificial Sequence
  Description of Artificial Sequence: Synthetic oligonucleotide
aagataccagggtaactctatga

SEQ ID NO: 893 - DNA, 23 bp, Artificial Sequence
  Description of Artificial Sequence: Synthetic oligonucleotide
aagatacctgaatatccaaccta

SEQ ID NO: 894 - DNA, 23 bp, Artificial Sequence
  Description of Artificial Sequence: Synthetic oligonucleotide
aagctgactgaagagcccttggg

SEQ ID NO: 895 - DNA, 23 bp, Artificial Sequence
  Description of Artificial Sequence: Synthetic oligonucleotide
agtatttctgacaaaccctcagg

SEQ ID NO: 896 - DNA, 22 bp, Artificial Sequence
  Description of Artificial Sequence: Synthetic oligonucleotide
gagatagctaataaccccctgg

SEQ ID NO: 897 - DNA, 23 bp, Artificial Sequence
  Description of Artificial Sequence: Synthetic oligonucleotide
aagacaactgaaaaacgctgtgg

SEQ ID NO: 898 - DNA, 23 bp, Artificial Sequence
  Description of Artificial Sequence: Synthetic oligonucleotide
aagacacctgaataatctctgga

SEQ ID NO: 899 - DNA, 23 bp, Artificial Sequence
  Description of Artificial Sequence: Synthetic oligonucleotide
atgataagtgaataagtctcatg

SEQ ID NO: 900 - DNA, 23 bp, Artificial Sequence
  Description of Artificial Sequence: Synthetic oligonucleotide
aggatatatgaaaaagcctgcgg

SEQ ID NO: 901 - DNA, 22 bp, Artificial Sequence
  Description of Artificial Sequence: Synthetic oligonucleotide
aagataccctaaaagcctttgg

SEQ ID NO: 902 - DNA, 23 bp, Artificial Sequence
  Description of Artificial Sequence: Synthetic oligonucleotide
aagatgcatgaataacctctgga

SEQ ID NO: 903 - DNA, 23 bp, Artificial Sequence
  Description of Artificial Sequence: Synthetic oligonucleotide
atgacaccagaaagaccctaagg

SEQ ID NO: 904 - DNA, 22 bp, Artificial Sequence
  Description of Artificial Sequence: Synthetic oligonucleotide
aaaatactaaataaccccatgg

SEQ ID NO: 905 - DNA, 23 bp, Artificial Sequence
  Description of Artificial Sequence: Synthetic oligonucleotide
cagattcctggaagaccctcaag

SEQ ID NO: 906 - DNA, 23 bp, Artificial Sequence
  Description of Artificial Sequence: Synthetic oligonucleotide
aagagacctcaaggtctctctgg

SEQ ID NO: 907 - DNA, 23 bp, Artificial Sequence
  Description of Artificial Sequence: Synthetic oligonucleotide
aagactaaagaataaccctctgg

SEQ ID NO: 908 - DNA, 23 bp, Artificial Sequence
  Description of Artificial Sequence: Synthetic oligonucleotide
aatatgcctacattacactcagg

SEQ ID NO: 909 - DNA, 22 bp, Artificial Sequence
  Description of Artificial Sequence: Synthetic oligonucleotide
aagacactgaataacccttggc

SEQ ID NO: 910 - DNA, 22 bp, Artificial Sequence
  Description of Artificial Sequence: Synthetic oligonucleotide
aagatagtgagtaagtctcagg

SEQ ID NO: 911 - DNA, 21 bp, Artificial Sequence
  Description of Artificial Sequence: Synthetic oligonucleotide
tagataagaatagccctcagg

SEQ ID NO: 912 - DNA, 23 bp, Artificial Sequence
  Description of Artificial Sequence: Synthetic oligonucleotide
tctatacctcaataacctcctgg

SEQ ID NO: 913 - DNA, 23 bp, Artificial Sequence
  Description of Artificial Sequence: Synthetic oligonucleotide
aagatacctaagtgctccacagg

SEQ ID NO: 914 - DNA, 24 bp, Artificial Sequence
  Description of Artificial Sequence: Synthetic oligonucleotide
aagaaacctacaataaccttcatg

SEQ ID NO: 915 - DNA, 23 bp, Artificial Sequence
  Description of Artificial Sequence: Synthetic oligonucleotide
ccgatatcagaatatcccttagg

SEQ ID NO: 916 - DNA, 23 bp, Artificial Sequence
  Description of Artificial Sequence: Synthetic oligonucleotide
aagatgcatgaaaaagcttcagt

SEQ ID NO: 917 - DNA, 23 bp, Artificial Sequence
  Description of Artificial Sequence: Synthetic oligonucleotide
tagatatctgcagaactctccgc

SEQ ID NO: 918 - DNA, 23 bp, Artificial Sequence
  Description of Artificial Sequence: Synthetic oligonucleotide
aacatacatcaataactttcttg

SEQ ID NO: 919 - DNA, 23 bp, Artificial Sequence
  Description of Artificial Sequence: Synthetic oligonucleotide
aagatacttgaataccaatcaag

SEQ ID NO: 920 - DNA, 22 bp, Artificial Sequence
  Description of Artificial Sequence: Synthetic oligonucleotide
taaagacctgaataacctcaag

SEQ ID NO: 921 - DNA, 22 bp, Artificial Sequence
  Description of Artificial Sequence: Synthetic oligonucleotide
aagatattgaatatacctcagg

SEQ ID NO: 922 - DNA, 23 bp, Artificial Sequence
  Description of Artificial Sequence: Synthetic oligonucleotide
tagttacctgaatacacctctgg

SEQ ID NO: 923 - DNA, 23 bp, Artificial Sequence
  Description of Artificial Sequence: Synthetic oligonucleotide
tatatacctggaaaaccctaaag

SEQ ID NO: 924 - DNA, 22 bp, Artificial Sequence
  Description of Artificial Sequence: Synthetic oligonucleotide
tagatacataataaccaactgg

SEQ ID NO: 925 - DNA, 21 bp, Artificial Sequence
  Description of Artificial Sequence: Synthetic oligonucleotide
gagatacttgaatccctcagg

SEQ ID NO: 926 - DNA, 23 bp, Artificial Sequence
  Description of Artificial Sequence: Synthetic oligonucleotide
aagatacctgtatgacactgtgt

SEQ ID NO: 927 - DNA, 23 bp, Artificial Sequence
  Description of Artificial Sequence: Synthetic oligonucleotide
aagatacctaaataacaagctgg

SEQ ID NO: 928 - DNA, 23 bp, Artificial Sequence
  Description of Artificial Sequence: Synthetic oligonucleotide
aggatacatgcataacccatgag

SEQ ID NO: 929 - DNA, 22 bp, Artificial Sequence
  Description of Artificial Sequence: Synthetic oligonucleotide
aagatccagaataattctctgg

SEQ ID NO: 930 - DNA, 23 bp, Artificial Sequence
  Description of Artificial Sequence: Synthetic oligonucleotide
aagatacatgaaaaattctctca

SEQ ID NO: 931 - DNA, 23 bp, Artificial Sequence
  Description of Artificial Sequence: Synthetic oligonucleotide
aatataccctaataagccttctg

SEQ ID NO: 932 - DNA, 25 bp, Artificial Sequence
  Description of Artificial Sequence: Synthetic oligonucleotide
aagatggctgaatagaaccttccag

SEQ ID NO: 933 - DNA, 23 bp, Artificial Sequence
  Description of Artificial Sequence: Synthetic oligonucleotide
aatataccttattatccttcaga

SEQ ID NO: 934 - DNA, 23 bp, Artificial Sequence
  Description of Artificial Sequence: Synthetic oligonucleotide
cagatacaagagtactcctcagg

SEQ ID NO: 935 - DNA, 23 bp, Artificial Sequence
  Description of Artificial Sequence: Synthetic oligonucleotide
tctatacctaaataaacctaagg

SEQ ID NO: 936 - DNA, 23 bp, Artificial Sequence
  Description of Artificial Sequence: Synthetic oligonucleotide
tagatacctcaataattctctct

SEQ ID NO: 937 - DNA, 23 bp, Artificial Sequence
  Description of Artificial Sequence: Synthetic oligonucleotide
aaataacataaataaccctcaga

SEQ ID NO: 938 - DNA, 22 bp, Artificial Sequence
  Description of Artificial Sequence: Synthetic oligonucleotide
cagaagctggatagccctcggg

SEQ ID NO: 939 - DNA, 22 bp, Artificial Sequence
  Description of Artificial Sequence: Synthetic oligonucleotide
aagaacatgagtaaccctaagg

SEQ ID NO: 940 - DNA, 23 bp, Artificial Sequence
  Description of Artificial Sequence: Synthetic oligonucleotide
aagatacttgaaaaacaccaggt

SEQ ID NO: 941 - DNA, 22 bp, Artificial Sequence
  Description of Artificial Sequence: Synthetic oligonucleotide
aagagaactgaaaagcctcaag

SEQ ID NO: 942 - DNA, 22 bp, Artificial Sequence
  Description of Artificial Sequence: Synthetic oligonucleotide
aagataccaaataactctctgg

SEQ ID NO: 943 - DNA, 21 bp, Artificial Sequence
  Description of Artificial Sequence: Synthetic oligonucleotide
aatatgcctgtaaccctcaag

SEQ ID NO: 944 - DNA, 23 bp, Artificial Sequence
  Description of Artificial Sequence: Synthetic oligonucleotide
aagctgactgaagagcccttagg

SEQ ID NO: 945 - DNA, 23 bp, Artificial Sequence
  Description of Artificial Sequence: Synthetic oligonucleotide
aaaattcatgaagaaccctgggt

SEQ ID NO: 946 - DNA, 23 bp, Artificial Sequence
  Description of Artificial Sequence: Synthetic oligonucleotide
aagatacgtgaataactcaggat

SEQ ID NO: 947 - DNA, 23 bp, Artificial Sequence
  Description of Artificial Sequence: Synthetic oligonucleotide
aagatatctgaacaattctaagg

SEQ ID NO: 948 - DNA, 23 bp, Artificial Sequence
  Description of Artificial Sequence: Synthetic oligonucleotide
aagatacttgaatcactgtcagt

SEQ ID NO: 949 - DNA, 22 bp, Artificial Sequence
  Description of Artificial Sequence: Synthetic oligonucleotide
aagatcctgaataattctctgg

SEQ ID NO: 950 - DNA, 23 bp, Artificial Sequence
  Description of Artificial Sequence: Synthetic oligonucleotide
aagaagcctggatagaactctgg

SEQ ID NO: 951 - DNA, 23 bp, Artificial Sequence
  Description of Artificial Sequence: Synthetic oligonucleotide
ttgatacctgaataacactccag

SEQ ID NO: 952 - DNA, 23 bp, Artificial Sequence
  Description of Artificial Sequence: Synthetic oligonucleotide
aaaaaaaatgaattaccctcatg

SEQ ID NO: 953 - DNA, 22 bp, Artificial Sequence
  Description of Artificial Sequence: Synthetic oligonucleotide
gagatccagaattacccttggg

SEQ ID NO: 954 - DNA, 23 bp, Artificial Sequence
  Description of Artificial Sequence: Synthetic oligonucleotide
aacatacctaaataactcctggc

SEQ ID NO: 955 - DNA, 22 bp, Artificial Sequence
  Description of Artificial Sequence: Synthetic oligonucleotide
aatctacctgatgaccctcggc

SEQ ID NO: 956 - DNA, 25 bp, Artificial Sequence
  Description of Artificial Sequence: Synthetic oligonucleotide
aagttaactgtaaaacagcctcagg

SEQ ID NO: 957 - DNA, 22 bp, Artificial Sequence
  Description of Artificial Sequence: Synthetic oligonucleotide
aagaaatctgaaagccctgggg

SEQ ID NO: 958 - DNA, 23 bp, Artificial Sequence
  Description of Artificial Sequence: Synthetic oligonucleotide
gagatacctgcataacacttaat

SEQ ID NO: 959 - DNA, 23 bp, Artificial Sequence
  Description of Artificial Sequence: Synthetic oligonucleotide
cagataactgaacaaccagatgg

SEQ ID NO: 960 - DNA, 23 bp, Artificial Sequence
  Description of Artificial Sequence: Synthetic oligonucleotide
aacttaggtgattaaccctcacg

SEQ ID NO: 961 - DNA, 22 bp, Artificial Sequence
  Description of Artificial Sequence: Synthetic oligonucleotide
atgatactgaataagtctcagg

SEQ ID NO: 962 - DNA, 22 bp, Artificial Sequence
  Description of Artificial Sequence: Synthetic oligonucleotide
agaatacctagtgaccctcagg

SEQ ID NO: 963 - DNA, 23 bp, Artificial Sequence
  Description of Artificial Sequence: Synthetic oligonucleotide
aacagaccttcatagccctcaga

SEQ ID NO: 964 - DNA, 22 bp, Artificial Sequence
  Description of Artificial Sequence: Synthetic oligonucleotide
tatatacctaaataacctaggg

SEQ ID NO: 965 - DNA, 23 bp, Artificial Sequence
  Description of Artificial Sequence: Synthetic oligonucleotide
aagatctctgaaatgccctgagg

SEQ ID NO: 966 - DNA, 23 bp, Artificial Sequence
  Description of Artificial Sequence: Synthetic oligonucleotide
aacttaacataataaccttcagg

SEQ ID NO: 967 - DNA, 22 bp, Artificial Sequence
  Description of Artificial Sequence: Synthetic oligonucleotide
atgatagtgaataatcctcatg

SEQ ID NO: 968 - DNA, 23 bp, Artificial Sequence
  Description of Artificial Sequence: Synthetic oligonucleotide
aagatacgagaataacctcaaga

SEQ ID NO: 969 - DNA, 23 bp, Artificial Sequence
  Description of Artificial Sequence: Synthetic oligonucleotide
aaactacctggatgaccctctga

SEQ ID NO: 970 - DNA, 22 bp, Artificial Sequence
  Description of Artificial Sequence: Synthetic oligonucleotide
aagaagatgaattactctctgg

SEQ ID NO: 971 - DNA, 22 bp, Artificial Sequence
  Description of Artificial Sequence: Synthetic oligonucleotide
aagatacagagtaactcttggg

SEQ ID NO: 972 - DNA, 23 bp, Artificial Sequence
  Description of Artificial Sequence: Synthetic oligonucleotide
gagatagctgaataatccctcag

SEQ ID NO: 973 - DNA, 23 bp, Artificial Sequence
  Description of Artificial Sequence: Synthetic oligonucleotide
aagatacatcagtaagccacagt

SEQ ID NO: 974 - DNA, 23 bp, Artificial Sequence
  Description of Artificial Sequence: Synthetic oligonucleotide
aaaatacattaataaaactaagg

SEQ ID NO: 975 - DNA, 23 bp, Artificial Sequence
  Description of Artificial Sequence: Synthetic oligonucleotide
agtagaggtgaataaccctcagc

SEQ ID NO: 976 - DNA, 23 bp, Artificial Sequence
  Description of Artificial Sequence: Synthetic oligonucleotide
cagatacttaaataaccataagg

SEQ ID NO: 977 - DNA, 22 bp, Artificial Sequence
  Description of Artificial Sequence: Synthetic oligonucleotide
aagaacctgacaagccctcaga

SEQ ID NO: 978 - DNA, 23 bp, Artificial Sequence
  Description of Artificial Sequence: Synthetic oligonucleotide
aagatccatcaataaaccacgtg

SEQ ID NO: 979 - DNA, 23 bp, Artificial Sequence
  Description of Artificial Sequence: Synthetic oligonucleotide
aagatacttttaaaacccagtgg

SEQ ID NO: 980 - DNA, 22 bp, Artificial Sequence
  Description of Artificial Sequence: Synthetic oligonucleotide
aagatcctgaattactctcaag

SEQ ID NO: 981 - DNA, 23 bp, Artificial Sequence
  Description of Artificial Sequence: Synthetic oligonucleotide
aagatacctgaacaactccacac

SEQ ID NO: 982 - DNA, 23 bp, Artificial Sequence
  Description of Artificial Sequence: Synthetic oligonucleotide
aagctgactgaagagccctaggg

SEQ ID NO: 983 - DNA, 23 bp, Artificial Sequence
  Description of Artificial Sequence: Synthetic oligonucleotide
ttgatacctgtattacactcatg

SEQ ID NO: 984 - DNA, 24 bp, Artificial Sequence
  Description of Artificial Sequence: Synthetic oligonucleotide
aagatacagagaataaccctcaca

SEQ ID NO: 985 - DNA, 23 bp, Artificial Sequence
  Description of Artificial Sequence: Synthetic oligonucleotide
aaaatacctcactagctctccag

SEQ ID NO: 986 - DNA, 23 bp, Artificial Sequence
  Description of Artificial Sequence: Synthetic oligonucleotide
aaaataattgaaaaactctctgt

SEQ ID NO: 987 - DNA, 23 bp, Artificial Sequence
  Description of Artificial Sequence: Synthetic oligonucleotide
ataagaacagaataaccttctgg

SEQ ID NO: 988 - DNA, 23 bp, Artificial Sequence
  Description of Artificial Sequence: Synthetic oligonucleotide
aagagtcatgcatagccctccag

SEQ ID NO: 989 - DNA, 22 bp, Artificial Sequence
  Description of Artificial Sequence: Synthetic oligonucleotide
aagatactgaataaactcctgc

SEQ ID NO: 990 - DNA, 23 bp, Artificial Sequence
  Description of Artificial Sequence: Synthetic oligonucleotide
aagaaacacaaataaccatcaga

SEQ ID NO: 991 - DNA, 22 bp, Artificial Sequence
  Description of Artificial Sequence: Synthetic oligonucleotide
gagatgctgaataactctctgg

SEQ ID NO: 992 - DNA, 22 bp, Artificial Sequence
  Description of Artificial Sequence: Synthetic oligonucleotide
aagatactgagtatctcacagg

SEQ ID NO: 993 - DNA, 25 bp, Artificial Sequence
  Description of Artificial Sequence: Synthetic oligonucleotide
aagacaccaagatagcaccctcggg

SEQ ID NO: 994 - DNA, 22 bp, Artificial Sequence
  Description of Artificial Sequence: Synthetic oligonucleotide
agtataccttaataccccctgg

SEQ ID NO: 995 - DNA, 22 bp, Artificial Sequence
  Description of Artificial Sequence: Synthetic oligonucleotide
attatacctaataaccctatgg

SEQ ID NO: 996 - DNA, 23 bp, Artificial Sequence
  Description of Artificial Sequence: Synthetic oligonucleotide
aatatagcccaatatccctcatg

SEQ ID NO: 997 - DNA, 23 bp, Artificial Sequence
  Description of Artificial Sequence: Synthetic oligonucleotide
cagatacctgaatgatccttttc

SEQ ID NO: 998 - DNA, 23 bp, Artificial Sequence
  Description of Artificial Sequence: Synthetic oligonucleotide
aagaaagctgagtagtcctcaga

SEQ ID NO: 999 - DNA, 23 bp, Artificial Sequence
  Description of Artificial Sequence: Synthetic oligonucleotide
aagggacaggaagaaccctgagg

SEQ ID NO: 1000 - DNA, 23 bp, Artificial Sequence
  Description of Artificial Sequence: Synthetic oligonucleotide
aagatagctgtataacctttatc

SEQ ID NO: 1001 - DNA, 24 bp, Artificial Sequence
  Description of Artificial Sequence: Synthetic oligonucleotide
aagttagcggaactcaccctcagg

SEQ ID NO: 1002 - DNA, 23 bp, Artificial Sequence
  Description of Artificial Sequence: Synthetic oligonucleotide
aagagagctagctagccctctgg

SEQ ID NO: 1003 - DNA, 23 bp, Artificial Sequence
  Description of Artificial Sequence: Synthetic oligonucleotide
aggatttctggataacactttgg

SEQ ID NO: 1004 - DNA, 23 bp, Artificial Sequence
  Description of Artificial Sequence: Synthetic oligonucleotide
gaagtacctgaaaaaccctctgc

SEQ ID NO: 1005 - DNA, 23 bp, Artificial Sequence
  Description of Artificial Sequence: Synthetic oligonucleotide
gaggtacttgaatcaccatcaag

SEQ ID NO: 1006 - DNA, 23 bp, Artificial Sequence
  Description of Artificial Sequence: Synthetic oligonucleotide
tagcttactgaataaccctaagg

SEQ ID NO: 1007 - DNA, 23 bp, Artificial Sequence
  Description of Artificial Sequence: Synthetic oligonucleotide
aagaggcatgaataaccctgttc

SEQ ID NO: 1008 - DNA, 21 bp, Artificial Sequence
  Description of Artificial Sequence: Synthetic oligonucleotide
cagttacgaataaccctcaga

SEQ ID NO: 1009 - DNA, 22 bp, Artificial Sequence
  Description of Artificial Sequence: Synthetic oligonucleotide
aagatactgaaaaaccctctga

SEQ ID NO: 1010 - DNA, 23 bp, Artificial Sequence
  Description of Artificial Sequence: Synthetic oligonucleotide
aacagacatgaagaaggctcagg

SEQ ID NO: 1011 - DNA, 23 bp, Artificial Sequence
  Description of Artificial Sequence: Synthetic oligonucleotide
accatacctgaaggaccatcttg

SEQ ID NO: 1012 - DNA, 22 bp, Artificial Sequence
  Description of Artificial Sequence: Synthetic oligonucleotide
aagagaccttaaaactctctgt

SEQ ID NO: 1013 - DNA, 23 bp, Artificial Sequence
  Description of Artificial Sequence: Synthetic oligonucleotide
acaagaccaaaataacccacagg

SEQ ID NO: 1014 - DNA, 23 bp, Artificial Sequence
  Description of Artificial Sequence: Synthetic oligonucleotide
acgatggcagaacaaacctcagg

SEQ ID NO: 1015 - DNA, 23 bp, Artificial Sequence
  Description of Artificial Sequence: Synthetic oligonucleotide
aagatacctcaaacaccagccgt

SEQ ID NO: 1016 - DNA, 23 bp, Artificial Sequence
  Description of Artificial Sequence: Synthetic oligonucleotide
aagacacctaaatatccctggga

SEQ ID NO: 1017 - DNA, 22 bp, Artificial Sequence
  Description of Artificial Sequence: Synthetic oligonucleotide
aagatactgactaatcatctgc

SEQ ID NO: 1018 - DNA, 23 bp, Artificial Sequence
  Description of Artificial Sequence: Synthetic oligonucleotide
tagacacctgagtcaccctctta

SEQ ID NO: 1019 - DNA, 22 bp, Artificial Sequence
  Description of Artificial Sequence: Synthetic oligonucleotide
gtgataccagattaacctctgg

SEQ ID NO: 1020 - DNA, 23 bp, Artificial Sequence
  Description of Artificial Sequence: Synthetic oligonucleotide
agagtaactgaataaccctacag

SEQ ID NO: 1021 - DNA, 23 bp, Artificial Sequence
  Description of Artificial Sequence: Synthetic oligonucleotide
tttgtaccagaataaccctcctg

SEQ ID NO: 1022 - DNA, 23 bp, Artificial Sequence
  Description of Artificial Sequence: Synthetic oligonucleotide
aaattaactgcataaccctgggt

SEQ ID NO: 1023 - DNA, 23 bp, Artificial Sequence
  Description of Artificial Sequence: Synthetic oligonucleotide
aaaaaacttgaattaccttctag

SEQ ID NO: 1024 - DNA, 23 bp, Artificial Sequence
  Description of Artificial Sequence: Synthetic oligonucleotide
ctgaaacctaaataatcccccgg

SEQ ID NO: 1025 - DNA, 23 bp, Artificial Sequence
  Description of Artificial Sequence: Synthetic oligonucleotide
aagacccaggaatcacactctgg

SEQ ID NO: 1026 - DNA, 22 bp, Artificial Sequence
  Description of Artificial Sequence: Synthetic oligonucleotide
agaagacctgaatacccccagg

SEQ ID NO: 1027 - DNA, 23 bp, Artificial Sequence
  Description of Artificial Sequence: Synthetic oligonucleotide
caaatacctaaagaactctcctg

SEQ ID NO: 1028 - DNA, 22 bp, Artificial Sequence
  Description of Artificial Sequence: Synthetic oligonucleotide
cctatacctaataaccttcagg

SEQ ID NO: 1029 - DNA, 23 bp, Artificial Sequence
  Description of Artificial Sequence: Synthetic oligonucleotide
aagatacctggaaaactcccaaa

SEQ ID NO: 1030 - DNA, 22 bp, Artificial Sequence
  Description of Artificial Sequence: Synthetic oligonucleotide
tagacacctaataatccccagg

SEQ ID NO: 1031 - DNA, 23 bp, Artificial Sequence
  Description of Artificial Sequence: Synthetic oligonucleotide
gtgatacctgtcagaccctcggg

SEQ ID NO: 1032 - DNA, 23 bp, Artificial Sequence
  Description of Artificial Sequence: Synthetic oligonucleotide
aagataccagaattcccctcttc

SEQ ID NO: 1033 - DNA, 23 bp, Artificial Sequence
  Description of Artificial Sequence: Synthetic oligonucleotide
aagatggctgagaaaaactcagg

SEQ ID NO: 1034 - DNA, 23 bp, Artificial Sequence
  Description of Artificial Sequence: Synthetic oligonucleotide
cgtgtaccagaatcaccctcagg

SEQ ID NO: 1035 - DNA, 22 bp, Artificial Sequence
  Description of Artificial Sequence: Synthetic oligonucleotide
aagaacttgtagaaccatcagg

SEQ ID NO: 1036 - DNA, 23 bp, Artificial Sequence
  Description of Artificial Sequence: Synthetic oligonucleotide
aagataccccatcacccctcccg

SEQ ID NO: 1037 - DNA, 24 bp, Artificial Sequence
  Description of Artificial Sequence: Synthetic oligonucleotide
aagatcagcagaagaaccttctgg

SEQ ID NO: 1038 - DNA, 23 bp, Artificial Sequence
  Description of Artificial Sequence: Synthetic oligonucleotide
agtatacctaaacaaacctcaga

SEQ ID NO: 1039 - DNA, 22 bp, Artificial Sequence
  Description of Artificial Sequence: Synthetic oligonucleotide
aagatcctgcatacccttctgt

SEQ ID NO: 1040 - DNA, 22 bp, Artificial Sequence
  Description of Artificial Sequence: Synthetic oligonucleotide
aagatccagattaaccctctag

SEQ ID NO: 1041 - DNA, 23 bp, Artificial Sequence
  Description of Artificial Sequence: Synthetic oligonucleotide
aacatccctgaagacccttgagg

SEQ ID NO: 1042 - DNA, 23 bp, Artificial Sequence
  Description of Artificial Sequence: Synthetic oligonucleotide
aagatacctgggtccccatttgg

SEQ ID NO: 1043 - DNA, 22 bp, Artificial Sequence
  Description of Artificial Sequence: Synthetic oligonucleotide
aagatccttaaataccctctgg

SEQ ID NO: 1044 - DNA, 23 bp, Artificial Sequence
  Description of Artificial Sequence: Synthetic oligonucleotide
aagataactaactcaccttcccg

SEQ ID NO: 1045 - DNA, 23 bp, Artificial Sequence
  Description of Artificial Sequence: Synthetic oligonucleotide
atgatatatgaacaaccctctgg

SEQ ID NO: 1046 - DNA, 23 bp, Artificial Sequence
  Description of Artificial Sequence: Synthetic oligonucleotide
aacatactcgaatacccctcaaa

SEQ ID NO: 1047 - DNA, 23 bp, Artificial Sequence
  Description of Artificial Sequence: Synthetic oligonucleotide
agcttacctgcttaaccctcagg

SEQ ID NO: 1048 - DNA, 23 bp, Artificial Sequence
  Description of Artificial Sequence: Synthetic oligonucleotide
aagataccaaaattccccaatgg

SEQ ID NO: 1049 - DNA, 23 bp, Artificial Sequence
  Description of Artificial Sequence: Synthetic oligonucleotide
acgatactggaataagcctttga

SEQ ID NO: 1050 - DNA, 22 bp, Artificial Sequence
  Description of Artificial Sequence: Synthetic oligonucleotide
cagtacctcaacaaccccctgg

SEQ ID NO: 1051 - DNA, 22 bp, Artificial Sequence
  Description of Artificial Sequence: Synthetic oligonucleotide
aatatcctgaataaacctctag

SEQ ID NO: 1052 - DNA, 23 bp, Artificial Sequence
  Description of Artificial Sequence: Synthetic oligonucleotide
aagacacctgataaaaactctgt

SEQ ID NO: 1053 - DNA, 22 bp, Artificial Sequence
  Description of Artificial Sequence: Synthetic oligonucleotide
aagatacagaataaacctaagg

SEQ ID NO: 1054 - DNA, 23 bp, Artificial Sequence
  Description of Artificial Sequence: Synthetic oligonucleotide
gagatacttgaacaactcactgg

SEQ ID NO: 1055 - DNA, 23 bp, Artificial Sequence
  Description of Artificial Sequence: Synthetic oligonucleotide
aagaaaccagagaaaccttcgag

SEQ ID NO: 1056 - DNA, 23 bp, Artificial Sequence
  Description of Artificial Sequence: Synthetic oligonucleotide
aaagtacctaaataaccaaccag

SEQ ID NO: 1057 - DNA, 22 bp, Artificial Sequence
  Description of Artificial Sequence: Synthetic oligonucleotide
aagaaggtgaataacacttagg

SEQ ID NO: 1058 - DNA, 23 bp, Artificial Sequence
  Description of Artificial Sequence: Synthetic oligonucleotide
aagatacctggctagccatatgc

SEQ ID NO: 1059 - DNA, 23 bp, Artificial Sequence
  Description of Artificial Sequence: Synthetic oligonucleotide
aagctaccagaggaacaatcagg

SEQ ID NO: 1060 - DNA, 22 bp, Artificial Sequence
  Description of Artificial Sequence: Synthetic oligonucleotide
catttactgaataaccctttgg

SEQ ID NO: 1061 - DNA, 23 bp, Artificial Sequence
  Description of Artificial Sequence: Synthetic oligonucleotide
gataaacatgaaggaccctcagg

SEQ ID NO: 1062 - DNA, 23 bp, Artificial Sequence
  Description of Artificial Sequence: Synthetic oligonucleotide
aacgtacctgaacaaccctcagg

SEQ ID NO: 1063 - DNA, 23 bp, Artificial Sequence
  Description of Artificial Sequence: Synthetic oligonucleotide
acactacctgaatgaccctcaag

SEQ ID NO: 1064 - DNA, 23 bp, Artificial Sequence
  Description of Artificial Sequence: Synthetic oligonucleotide
aatatacatgaaacacacttagg

SEQ ID NO: 1065 - DNA, 23 bp, Artificial Sequence
  Description of Artificial Sequence: Synthetic oligonucleotide
aagatacctaaatgtccatcaac

SEQ ID NO: 1066 - DNA, 21 bp, Artificial Sequence
  Description of Artificial Sequence: Synthetic oligonucleotide
cagatatgaataaacctctag

SEQ ID NO: 1067 - DNA, 23 bp, Artificial Sequence
  Description of Artificial Sequence: Synthetic oligonucleotide
aatagtactcaataaacctctgg

SEQ ID NO: 1068 - DNA, 23 bp, Artificial Sequence
  Description of Artificial Sequence: Synthetic oligonucleotide
agtatacatgaatagccctcagg

SEQ ID NO: 1069 - DNA, 23 bp, Artificial Sequence
  Description of Artificial Sequence: Synthetic oligonucleotide
ttgctacctgaataaccctcttg

SEQ ID NO: 1070 - DNA, 23 bp, Artificial Sequence
  Description of Artificial Sequence: Synthetic oligonucleotide
aagatatctgaggaagcgtcttg

SEQ ID NO: 1071 - DNA, 21 bp, Artificial Sequence
  Description of Artificial Sequence: Synthetic oligonucleotide
aagatacctgaaaccctctgg

SEQ ID NO: 1072 - DNA, 22 bp, Artificial Sequence
  Description of Artificial Sequence: Synthetic oligonucleotide
cagatattgaaaaaccctctgg

SEQ ID NO: 1073 - DNA, 23 bp, Artificial Sequence
  Description of Artificial Sequence: Synthetic oligonucleotide
aaggtatccaaataaccctttgg

SEQ ID NO: 1074 - DNA, 23 bp, Artificial Sequence
  Description of Artificial Sequence: Synthetic oligonucleotide
taaatacctgaacaactctaggg

SEQ ID NO: 1075 - DNA, 24 bp, Artificial Sequence
  Description of Artificial Sequence: Synthetic oligonucleotide
aagattacatgagtacccctcctg

SEQ ID NO: 1076 - DNA, 22 bp, Artificial Sequence
  Description of Artificial Sequence: Synthetic oligonucleotide
atgatagtgaataactctcttg

SEQ ID NO: 1077 - DNA, 23 bp, Artificial Sequence
  Description of Artificial Sequence: Synthetic oligonucleotide
aagatatctgaaaaatccacaaa

SEQ ID NO: 1078 - DNA, 22 bp, Artificial Sequence
  Description of Artificial Sequence: Synthetic oligonucleotide
aagatttcttataaccctctgg

SEQ ID NO: 1079 - DNA, 24 bp, Artificial Sequence
  Description of Artificial Sequence: Synthetic oligonucleotide
aagatactctgaataactttctgg

SEQ ID NO: 1080 - DNA, 23 bp, Artificial Sequence
  Description of Artificial Sequence: Synthetic oligonucleotide
aagtcatctgaataaccctcaag

SEQ ID NO: 1081 - DNA, 24 bp, Artificial Sequence
  Description of Artificial Sequence: Synthetic oligonucleotide
aagatacgtgcaataactatcaag

SEQ ID NO: 1082 - DNA, 23 bp, Artificial Sequence
  Description of Artificial Sequence: Synthetic oligonucleotide
aagatacattagtaacattttgg

SEQ ID NO: 1083 - DNA, 24 bp, Artificial Sequence
  Description of Artificial Sequence: Synthetic oligonucleotide
aagaaacacttaaaaaccatctgg

SEQ ID NO: 1084 - DNA, 23 bp, Artificial Sequence
  Description of Artificial Sequence: Synthetic oligonucleotide
tagatacctgtataaccaccacc

SEQ ID NO: 1085 - DNA, 23 bp, Artificial Sequence
  Description of Artificial Sequence: Synthetic oligonucleotide
aacttacctgaacatgcccctgg

SEQ ID NO: 1086 - DNA, 23 bp, Artificial Sequence
  Description of Artificial Sequence: Synthetic oligonucleotide
tagatacatggattaacttctgg

SEQ ID NO: 1087 - DNA, 23 bp, Artificial Sequence
  Description of Artificial Sequence: Synthetic oligonucleotide
aagacagcagtaaaacactctgg

SEQ ID NO: 1088 - DNA, 22 bp, Artificial Sequence
  Description of Artificial Sequence: Synthetic oligonucleotide
aagatctggaagaactctctgg

SEQ ID NO: 1089 - DNA, 23 bp, Artificial Sequence
  Description of Artificial Sequence: Synthetic oligonucleotide
aagaaaggtgagcaacactcggg

SEQ ID NO: 1090 - DNA, 23 bp, Artificial Sequence
  Description of Artificial Sequence: Synthetic oligonucleotide
aagatactttaaaaaacccctgc

SEQ ID NO: 1091 - DNA, 23 bp, Artificial Sequence
  Description of Artificial Sequence: Synthetic oligonucleotide
aatatacctagctaagcctcaga

SEQ ID NO: 1092 - DNA, 24 bp, Artificial Sequence
  Description of Artificial Sequence: Synthetic oligonucleotide
aagatagcctgagtcacactcttg

SEQ ID NO: 1093 - DNA, 23 bp, Artificial Sequence
  Description of Artificial Sequence: Synthetic oligonucleotide
aagaaaacagcgtaagcctcagg

SEQ ID NO: 1094 - DNA, 23 bp, Artificial Sequence
  Description of Artificial Sequence: Synthetic oligonucleotide
atgaaacctaaataagtctctgg

SEQ ID NO: 1095 - DNA, 23 bp, Artificial Sequence
  Description of Artificial Sequence: Synthetic oligonucleotide
tgtttacctgaataaccttcagg

SEQ ID NO: 1096 - DNA, 23 bp, Artificial Sequence
  Description of Artificial Sequence: Synthetic oligonucleotide
aagatatctgaaaagcccacttt

SEQ ID NO: 1097 - DNA, 23 bp, Artificial Sequence
  Description of Artificial Sequence: Synthetic oligonucleotide
tgtaaacctggataaccctctag

SEQ ID NO: 1098 - DNA, 22 bp, Artificial Sequence
  Description of Artificial Sequence: Synthetic oligonucleotide
aagtatcatgaataccctcagg

SEQ ID NO: 1099 - DNA, 22 bp, Artificial Sequence
  Description of Artificial Sequence: Synthetic oligonucleotide
aagatcctatataaccctctga

SEQ ID NO: 1100 - DNA, 23 bp, Artificial Sequence
  Description of Artificial Sequence: Synthetic oligonucleotide
aaaatacctgaataacctgggcc

SEQ ID NO: 1101 - DNA, 23 bp, Artificial Sequence
  Description of Artificial Sequence: Synthetic oligonucleotide
aagttaccagaacaacccttagg

SEQ ID NO: 1102 - DNA, 22 bp, Artificial Sequence
  Description of Artificial Sequence: Synthetic oligonucleotide
aagaatttgaataactctctag

SEQ ID NO: 1103 - DNA, 21 bp, Artificial Sequence
  Description of Artificial Sequence: Synthetic oligonucleotide
aggatacctgaatccctccag

SEQ ID NO: 1104 - DNA, 23 bp, Artificial Sequence
  Description of Artificial Sequence: Synthetic oligonucleotide
gagacacctgaataagtgtctgg

SEQ ID NO: 1105 - DNA, 22 bp, Artificial Sequence
  Description of Artificial Sequence: Synthetic oligonucleotide
aagctagtgaaaaaccatcagg

SEQ ID NO: 1106 - DNA, 23 bp, Artificial Sequence
  Description of Artificial Sequence: Synthetic oligonucleotide
aggatacttgaatatccctgcct

SEQ ID NO: 1107 - DNA, 22 bp, Artificial Sequence
  Description of Artificial Sequence: Synthetic oligonucleotide
cagatactgaaaaacactctgg

SEQ ID NO: 1108 - DNA, 23 bp, Artificial Sequence
  Description of Artificial Sequence: Synthetic oligonucleotide
aagaaatctggataacccccaat

SEQ ID NO: 1109 - DNA, 23 bp, Artificial Sequence
  Description of Artificial Sequence: Synthetic oligonucleotide
aacatacccaaaaaaacctctga

SEQ ID NO: 1110 - DNA, 23 bp, Artificial Sequence
  Description of Artificial Sequence: Synthetic oligonucleotide
aaaatatccaaataaccccctgg

SEQ ID NO: 1111 - DNA, 23 bp, Artificial Sequence
  Description of Artificial Sequence: Synthetic oligonucleotide
aagatatctgaataatcatcagg

SEQ ID NO: 1112 - DNA, 22 bp, Artificial Sequence
  Description of Artificial Sequence: Synthetic oligonucleotide
aagatactgagtaacactgaag

SEQ ID NO: 1113 - DNA, 21 bp, Artificial Sequence
  Description of Artificial Sequence: Synthetic oligonucleotide
aagttacctaaataactttgg

SEQ ID NO: 1114 - DNA, 23 bp, Artificial Sequence
  Description of Artificial Sequence: Synthetic oligonucleotide
accataattgattaactctctgg

SEQ ID NO: 1115 - DNA, 23 bp, Artificial Sequence
  Description of Artificial Sequence: Synthetic oligonucleotide
aagaaacctaagtaaacctctaa

SEQ ID NO: 1116 - DNA, 22 bp, Artificial Sequence
  Description of Artificial Sequence: Synthetic oligonucleotide
aagatacatcatcaccctcctg

SEQ ID NO: 1117 - DNA, 23 bp, Artificial Sequence
  Description of Artificial Sequence: Synthetic oligonucleotide
aagacacataaggaaccctcatg

SEQ ID NO: 1118 - DNA, 23 bp, Artificial Sequence
  Description of Artificial Sequence: Synthetic oligonucleotide
gagatacctgagctgccctcagc

SEQ ID NO: 1119 - DNA, 23 bp, Artificial Sequence
  Description of Artificial Sequence: Synthetic oligonucleotide
gagatacctaaataaccttccag

SEQ ID NO: 1120 - DNA, 21 bp, Artificial Sequence
  Description of Artificial Sequence: Synthetic oligonucleotide
aagatacgaataatcctccga

SEQ ID NO: 1121 - DNA, 23 bp, Artificial Sequence
  Description of Artificial Sequence: Synthetic oligonucleotide
attaaaccaaaataaccctcggg

SEQ ID NO: 1122 - DNA, 23 bp, Artificial Sequence
  Description of Artificial Sequence: Synthetic oligonucleotide
cacaaaccttaataaccctcaag

SEQ ID NO: 1123 - DNA, 23 bp, Artificial Sequence
  Description of Artificial Sequence: Synthetic oligonucleotide
aagataaaaaaatacccctaggg

SEQ ID NO: 1124 - DNA, 23 bp, Artificial Sequence
  Description of Artificial Sequence: Synthetic oligonucleotide
aagatatctgaaaaagtcttgag

SEQ ID NO: 1125 - DNA, 23 bp, Artificial Sequence
  Description of Artificial Sequence: Synthetic oligonucleotide
gagataactgaataaccatttgg

SEQ ID NO: 1126 - DNA, 23 bp, Artificial Sequence
  Description of Artificial Sequence: Synthetic oligonucleotide
aagatatctgtaaaacccttcag

SEQ ID NO: 1127 - DNA, 23 bp, Artificial Sequence
  Description of Artificial Sequence: Synthetic oligonucleotide
aacatacatgaaaaatcctcaac

SEQ ID NO: 1128 - DNA, 23 bp, Artificial Sequence
  Description of Artificial Sequence: Synthetic oligonucleotide
aaggtaactggatagccatctgc

SEQ ID NO: 1129 - DNA, 23 bp, Artificial Sequence
  Description of Artificial Sequence: Synthetic oligonucleotide
aagagacctgagtcaccctgtct

SEQ ID NO: 1130 - DNA, 23 bp, Artificial Sequence
  Description of Artificial Sequence: Synthetic oligonucleotide
aagataaatgaatttccttctgt

SEQ ID NO: 1131 - DNA, 23 bp, Artificial Sequence
  Description of Artificial Sequence: Synthetic oligonucleotide
aagatacgggaaatcccctttgg

SEQ ID NO: 1132 - DNA, 22 bp, Artificial Sequence
  Description of Artificial Sequence: Synthetic oligonucleotide
cagatatcagataaccctatgg

SEQ ID NO: 1133 - DNA, 23 bp, Artificial Sequence
  Description of Artificial Sequence: Synthetic oligonucleotide
cagatgcttgtaaaaccatcagg

SEQ ID NO: 1134 - DNA, 23 bp, Artificial Sequence
  Description of Artificial Sequence: Synthetic oligonucleotide
acagtagttgcataaccctctgg

SEQ ID NO: 1135 - DNA, 23 bp, Artificial Sequence
  Description of Artificial Sequence: Synthetic oligonucleotide
aagattcagcactaacccacagg

SEQ ID NO: 1136 - DNA, 22 bp, Artificial Sequence
  Description of Artificial Sequence: Synthetic oligonucleotide
gagatactgaattaccctctgg

SEQ ID NO: 1137 - DNA, 23 bp, Artificial Sequence
  Description of Artificial Sequence: Synthetic oligonucleotide
aagagacatgcataatcttcagg

SEQ ID NO: 1138 - DNA, 22 bp, Artificial Sequence
  Description of Artificial Sequence: Synthetic oligonucleotide
aagtaaactgaataccttctgg

SEQ ID NO: 1139 - DNA, 23 bp, Artificial Sequence
  Description of Artificial Sequence: Synthetic oligonucleotide
aagaaaccactataaccatcagt

SEQ ID NO: 1140 - DNA, 22 bp, Artificial Sequence
  Description of Artificial Sequence: Synthetic oligonucleotide
cagatactgtataaccctcaga

SEQ ID NO: 1141 - DNA, 23 bp, Artificial Sequence
  Description of Artificial Sequence: Synthetic oligonucleotide
aatgtaaatgtataaccctctgt

SEQ ID NO: 1142 - DNA, 23 bp, Artificial Sequence
  Description of Artificial Sequence: Synthetic oligonucleotide
aggataccataataaccagcatg

SEQ ID NO: 1143 - DNA, 23 bp, Artificial Sequence
  Description of Artificial Sequence: Synthetic oligonucleotide
gcaatacctgaataacccattgt

SEQ ID NO: 1144 - DNA, 23 bp, Artificial Sequence
  Description of Artificial Sequence: Synthetic oligonucleotide
aagataccagaccatctcccagg

SEQ ID NO: 1145 - DNA, 21 bp, Artificial Sequence
  Description of Artificial Sequence: Synthetic oligonucleotide
aagatctgaatagcaccctgg

SEQ ID NO: 1146 - DNA, 23 bp, Artificial Sequence
  Description of Artificial Sequence: Synthetic oligonucleotide
aagatcacaggacaaccctccgc

SEQ ID NO: 1147 - DNA, 22 bp, Artificial Sequence
  Description of Artificial Sequence: Synthetic oligonucleotide
aagattcatgataaccatcatg

SEQ ID NO: 1148 - DNA, 23 bp, Artificial Sequence
  Description of Artificial Sequence: Synthetic oligonucleotide
caggtacctggagaaccctagag

SEQ ID NO: 1149 - DNA, 23 bp, Artificial Sequence
  Description of Artificial Sequence: Synthetic oligonucleotide
aagatacctgaacaccctactgg

SEQ ID NO: 1150 - DNA, 22 bp, Artificial Sequence
  Description of Artificial Sequence: Synthetic oligonucleotide
tagctagctgataacactctgg

SEQ ID NO: 1151 - DNA, 22 bp, Artificial Sequence
  Description of Artificial Sequence: Synthetic oligonucleotide
attatactgaataaccttccag

SEQ ID NO: 1152 - DNA, 23 bp, Artificial Sequence
  Description of Artificial Sequence: Synthetic oligonucleotide
aagttacctgcatcaaactcatg

SEQ ID NO: 1153 - DNA, 22 bp, Artificial Sequence
  Description of Artificial Sequence: Synthetic oligonucleotide
aagatacagaataaccctctag

SEQ ID NO: 1154 - DNA, 23 bp, Artificial Sequence
  Description of Artificial Sequence: Synthetic oligonucleotide
gatatactctaataaccctcaag

SEQ ID NO: 1155 - DNA, 23 bp, Artificial Sequence
  Description of Artificial Sequence: Synthetic oligonucleotide
aagatacataaatcactttccag

SEQ ID NO: 1156 - DNA, 22 bp, Artificial Sequence
  Description of Artificial Sequence: Synthetic oligonucleotide
aaaatgcctaatagacctctgg

SEQ ID NO: 1157 - DNA, 23 bp, Artificial Sequence
  Description of Artificial Sequence: Synthetic oligonucleotide
aaaacacctgaaaaatcctccac

SEQ ID NO: 1158 - DNA, 24 bp, Artificial Sequence
  Description of Artificial Sequence: Synthetic oligonucleotide
aagaaacactgaatgtccctcttg

SEQ ID NO: 1159 - DNA, 23 bp, Artificial Sequence
  Description of Artificial Sequence: Synthetic oligonucleotide
gtgaaacctaaataaccctcaga

SEQ ID NO: 1160 - DNA, 23 bp, Artificial Sequence
  Description of Artificial Sequence: Synthetic oligonucleotide
aatataccagaatagttctcagt

SEQ ID NO: 1161 - DNA, 22 bp, Artificial Sequence
  Description of Artificial Sequence: Synthetic oligonucleotide
aagatactgaatattcctcagg

SEQ ID NO: 1162 - DNA, 23 bp, Artificial Sequence
  Description of Artificial Sequence: Synthetic oligonucleotide
gagatacttgaataaccatctca

SEQ ID NO: 1163 - DNA, 23 bp, Artificial Sequence
  Description of Artificial Sequence: Synthetic oligonucleotide
aaagtacattaaaaaccttctgg

SEQ ID NO: 1164 - DNA, 23 bp, Artificial Sequence
  Description of Artificial Sequence: Synthetic oligonucleotide
aagataattgaatagccatctta

SEQ ID NO: 1165 - DNA, 23 bp, Artificial Sequence
  Description of Artificial Sequence: Synthetic oligonucleotide
aacaaacccgtaaaaccctcacg

SEQ ID NO: 1166 - DNA, 23 bp, Artificial Sequence
  Description of Artificial Sequence: Synthetic oligonucleotide
aagatagttaaatatccccctgt

SEQ ID NO: 1167 - DNA, 22 bp, Artificial Sequence
  Description of Artificial Sequence: Synthetic oligonucleotide
aagataataaataaccctcaag

SEQ ID NO: 1168 - DNA, 22 bp, Artificial Sequence
  Description of Artificial Sequence: Synthetic oligonucleotide
aagctacttgataaccctatgg

SEQ ID NO: 1169 - DNA, 21 bp, Artificial Sequence
  Description of Artificial Sequence: Synthetic oligonucleotide
attatacctgaatccctcagg

SEQ ID NO: 1170 - DNA, 23 bp, Artificial Sequence
  Description of Artificial Sequence: Synthetic oligonucleotide
aagttatcctaataaccctatgg

SEQ ID NO: 1171 - DNA, 23 bp, Artificial Sequence
  Description of Artificial Sequence: Synthetic oligonucleotide
atgtttactgaatacccctctgg

SEQ ID NO: 1172 - DNA, 23 bp, Artificial Sequence
  Description of Artificial Sequence: Synthetic oligonucleotide
aagggacctgaaattccctgagg

SEQ ID NO: 1173 - DNA, 23 bp, Artificial Sequence
  Description of Artificial Sequence: Synthetic oligonucleotide
tagataacagaatgactcacagg

SEQ ID NO: 1174 - DNA, 22 bp, Artificial Sequence
  Description of Artificial Sequence: Synthetic oligonucleotide
aagattctgaatagaccccagg

SEQ ID NO: 1175 - DNA, 22 bp, Artificial Sequence
  Description of Artificial Sequence: Synthetic oligonucleotide
aacatacccaaatactctcagg

SEQ ID NO: 1176 - DNA, 23 bp, Artificial Sequence
  Description of Artificial Sequence: Synthetic oligonucleotide
aagatacctcaataagactcggg

SEQ ID NO: 1177 - DNA, 22 bp, Artificial Sequence
  Description of Artificial Sequence: Synthetic oligonucleotide
tagatactgaaaatctctcagg

SEQ ID NO: 1178 - DNA, 23 bp, Artificial Sequence
  Description of Artificial Sequence: Synthetic oligonucleotide
agaatacaagaataaccctgggg

SEQ ID NO: 1179 - DNA, 23 bp, Artificial Sequence
  Description of Artificial Sequence: Synthetic oligonucleotide
aagatacctgaaattcctgcaga

SEQ ID NO: 1180 - DNA, 22 bp, Artificial Sequence
  Description of Artificial Sequence: Synthetic oligonucleotide
ctggtacttaataaccctcagg

SEQ ID NO: 1181 - DNA, 23 bp, Artificial Sequence
  Description of Artificial Sequence: Synthetic oligonucleotide
gagatacctaacacacactctgg

SEQ ID NO: 1182 - DNA, 23 bp, Artificial Sequence
  Description of Artificial Sequence: Synthetic oligonucleotide
acaatacctgaaaaactcccttg

SEQ ID NO: 1183 - DNA, 22 bp, Artificial Sequence
  Description of Artificial Sequence: Synthetic oligonucleotide
cagatacattaaaaccctctgg

SEQ ID NO: 1184 - DNA, 23 bp, Artificial Sequence
  Description of Artificial Sequence: Synthetic oligonucleotide
cagaacccacaataagcctctgg

SEQ ID NO: 1185 - DNA, 22 bp, Artificial Sequence
  Description of Artificial Sequence: Synthetic oligonucleotide
aataacatgaataacactcaag

SEQ ID NO: 1186 - DNA, 22 bp, Artificial Sequence
  Description of Artificial Sequence: Synthetic oligonucleotide
aagtaacccaaataaccccagg

SEQ ID NO: 1187 - DNA, 22 bp, Artificial Sequence
  Description of Artificial Sequence: Synthetic oligonucleotide
aagatacagaatttccctttgg

SEQ ID NO: 1188 - DNA, 23 bp, Artificial Sequence
  Description of Artificial Sequence: Synthetic oligonucleotide
aaggtccctgagccaccctccag

SEQ ID NO: 1189 - DNA, 22 bp, Artificial Sequence
  Description of Artificial Sequence: Synthetic oligonucleotide
aagatctggaacaactctctgg

SEQ ID NO: 1190 - DNA, 23 bp, Artificial Sequence
  Description of Artificial Sequence: Synthetic oligonucleotide
aacactattgaataaccatctgg

SEQ ID NO: 1191 - DNA, 22 bp, Artificial Sequence
  Description of Artificial Sequence: Synthetic oligonucleotide
gggatacctgaatattctctgg

SEQ ID NO: 1192 - DNA, 23 bp, Artificial Sequence
  Description of Artificial Sequence: Synthetic oligonucleotide
aagatgcctgcacatccctcctt

SEQ ID NO: 1193 - DNA, 23 bp, Artificial Sequence
  Description of Artificial Sequence: Synthetic oligonucleotide
aagatacatgaattaccaaaaag

SEQ ID NO: 1194 - DNA, 23 bp, Artificial Sequence
  Description of Artificial Sequence: Synthetic oligonucleotide
aagatgcttgaagtagcttcagg

SEQ ID NO: 1195 - DNA, 24 bp, Artificial Sequence
  Description of Artificial Sequence: Synthetic oligonucleotide
tagatacctcttataaccctccag

SEQ ID NO: 1196 - DNA, 23 bp, Artificial Sequence
  Description of Artificial Sequence: Synthetic oligonucleotide
aagatacatcaataaacctgatt

SEQ ID NO: 1197 - DNA, 23 bp, Artificial Sequence
  Description of Artificial Sequence: Synthetic oligonucleotide
aagatagtcctataactctctgg

SEQ ID NO: 1198 - DNA, 23 bp, Artificial Sequence
  Description of Artificial Sequence: Synthetic oligonucleotide
aaaattagtggataaacctctgg

SEQ ID NO: 1199 - DNA, 22 bp, Artificial Sequence
  Description of Artificial Sequence: Synthetic oligonucleotide
aagatcctgaagaattctctga

SEQ ID NO: 1200 - DNA, 23 bp, Artificial Sequence
  Description of Artificial Sequence: Synthetic oligonucleotide
agaatacctgaacaacactctag

SEQ ID NO: 1201 - DNA, 21 bp, Artificial Sequence
  Description of Artificial Sequence: Synthetic oligonucleotide
attaaacctgaaaccctcagg

SEQ ID NO: 1202 - DNA, 22 bp, Artificial Sequence
  Description of Artificial Sequence: Synthetic oligonucleotide
aagatagctaaataacctctga

SEQ ID NO: 1203 - DNA, 23 bp, Artificial Sequence
  Description of Artificial Sequence: Synthetic oligonucleotide
gagacaactgattatccctcaag

SEQ ID NO: 1204 - DNA, 23 bp, Artificial Sequence
  Description of Artificial Sequence: Synthetic oligonucleotide
aatttaccagaatagccctctga

SEQ ID NO: 1205 - DNA, 23 bp, Artificial Sequence
  Description of Artificial Sequence: Synthetic oligonucleotide
aagatactgaaatacccctatgg

SEQ ID NO: 1206 - DNA, 23 bp, Artificial Sequence
  Description of Artificial Sequence: Synthetic oligonucleotide
aaggtaaatgagtaatcctttgg

SEQ ID NO: 1207 - DNA, 24 bp, Artificial Sequence
  Description of Artificial Sequence: Synthetic oligonucleotide
aagattacttgaagaagcctctga

SEQ ID NO: 1208 - DNA, 23 bp, Artificial Sequence
  Description of Artificial Sequence: Synthetic oligonucleotide
aaagtagctgaataaacctcaag

SEQ ID NO: 1209 - DNA, 23 bp, Artificial Sequence
  Description of Artificial Sequence: Synthetic oligonucleotide
aagataactgaaatgccttcgag

SEQ ID NO: 1210 - DNA, 23 bp, Artificial Sequence
  Description of Artificial Sequence: Synthetic oligonucleotide
actattcctgaataaccctttgg

SEQ ID NO: 1211 - DNA, 22 bp, Artificial Sequence
  Description of Artificial Sequence: Synthetic oligonucleotide
aacatcctgaatcaacctctgc

SEQ ID NO: 1212 - DNA, 22 bp, Artificial Sequence
  Description of Artificial Sequence: Synthetic oligonucleotide
gaaatactgagtacccctcagg

SEQ ID NO: 1213 - DNA, 22 bp, Artificial Sequence
  Description of Artificial Sequence: Synthetic oligonucleotide
tagatctagaataagcctctgg

SEQ ID NO: 1214 - DNA, 23 bp, Artificial Sequence
  Description of Artificial Sequence: Synthetic oligonucleotide
aagatacccaaataaccatcaga

SEQ ID NO: 1215 - DNA, 23 bp, Artificial Sequence
  Description of Artificial Sequence: Synthetic oligonucleotide
aagacagctaactaactctcggg

SEQ ID NO: 1216 - DNA, 23 bp, Artificial Sequence
  Description of Artificial Sequence: Synthetic oligonucleotide
aaagtagctgaacagccctcagg

SEQ ID NO: 1217 - DNA, 23 bp, Artificial Sequence
  Description of Artificial Sequence: Synthetic oligonucleotide
aagatacctcattaatcatcaca

SEQ ID NO: 1218 - DNA, 22 bp, Artificial Sequence
  Description of Artificial Sequence: Synthetic oligonucleotide
aagatatggaatcaacctcagg

SEQ ID NO: 1219 - DNA, 22 bp, Artificial Sequence
  Description of Artificial Sequence: Synthetic oligonucleotide
aagatacctaataaccacaggg

SEQ ID NO: 1220 - DNA, 23 bp, Artificial Sequence
  Description of Artificial Sequence: Synthetic oligonucleotide
acagcacctgaatcacactctgg

SEQ ID NO: 1221 - DNA, 23 bp, Artificial Sequence
  Description of Artificial Sequence: Synthetic oligonucleotide
aagatacaaaaacaaccgactgg

SEQ ID NO: 1222 - DNA, 22 bp, Artificial Sequence
  Description of Artificial Sequence: Synthetic oligonucleotide
aagatactcaataaacctcaag

SEQ ID NO: 1223 - DNA, 22 bp, Artificial Sequence
  Description of Artificial Sequence: Synthetic oligonucleotide
atgatagtgaataattctcagg

SEQ ID NO: 1224 - DNA, 23 bp, Artificial Sequence
  Description of Artificial Sequence: Synthetic oligonucleotide
aagacacataaaccactctcagg

SEQ ID NO: 1225 - DNA, 22 bp, Artificial Sequence
  Description of Artificial Sequence: Synthetic oligonucleotide
aagatactggataaccttccag

SEQ ID NO: 1226 - DNA, 22 bp, Artificial Sequence
  Description of Artificial Sequence: Synthetic oligonucleotide
atgataatgaataacccttggg

SEQ ID NO: 1227 - DNA, 22 bp, Artificial Sequence
  Description of Artificial Sequence: Synthetic oligonucleotide
aagacactgaaaaaccctcaag

SEQ ID NO: 1228 - DNA, 23 bp, Artificial Sequence
  Description of Artificial Sequence: Synthetic oligonucleotide
aagatagcagattagtcctcagt

SEQ ID NO: 1229 - DNA, 23 bp, Artificial Sequence
  Description of Artificial Sequence: Synthetic oligonucleotide
aagagatcgggataagcctttgg

SEQ ID NO: 1230 - DNA, 23 bp, Artificial Sequence
  Description of Artificial Sequence: Synthetic oligonucleotide
taagtacccaaataagcctctgg

SEQ ID NO: 1231 - DNA, 23 bp, Artificial Sequence
  Description of Artificial Sequence: Synthetic oligonucleotide
aagatatctgaatatggaccagg

SEQ ID NO: 1232 - DNA, 23 bp, Artificial Sequence
  Description of Artificial Sequence: Synthetic oligonucleotide
aagatagctaagaatccctccag

SEQ ID NO: 1233 - DNA, 22 bp, Artificial Sequence
  Description of Artificial Sequence: Synthetic oligonucleotide
tagttacaagaataaccccagg

SEQ ID NO: 1234 - DNA, 22 bp, Artificial Sequence
  Description of Artificial Sequence: Synthetic oligonucleotide
tagatacataatagccctttgg

SEQ ID NO: 1235 - DNA, 23 bp, Artificial Sequence
  Description of Artificial Sequence: Synthetic oligonucleotide
aagagccctgaataagctttagg

SEQ ID NO: 1236 - DNA, 22 bp, Artificial Sequence
  Description of Artificial Sequence: Synthetic oligonucleotide
aagatactgaataaacccgaag

SEQ ID NO: 1237 - DNA, 23 bp, Artificial Sequence
  Description of Artificial Sequence: Synthetic oligonucleotide
aagatatctggataatccccaaa

SEQ ID NO: 1238 - DNA, 24 bp, Artificial Sequence
  Description of Artificial Sequence: Synthetic oligonucleotide
aatataccttgaatacccctccct

SEQ ID NO: 1239 - DNA, 23 bp, Artificial Sequence
  Description of Artificial Sequence: Synthetic oligonucleotide
gggataccttaacaaccctgtgg

SEQ ID NO: 1240 - DNA, 23 bp, Artificial Sequence
  Description of Artificial Sequence: Synthetic oligonucleotide
aaaatacctgacagaaccactgg

SEQ ID NO: 1241 - DNA, 23 bp, Artificial Sequence
  Description of Artificial Sequence: Synthetic oligonucleotide
aaaatacctgagtgaccctagaa

SEQ ID NO: 1242 - DNA, 23 bp, Artificial Sequence
  Description of Artificial Sequence: Synthetic oligonucleotide
aagatttgtgaatgaccctaatg

SEQ ID NO: 1243 - DNA, 22 bp, Artificial Sequence
  Description of Artificial Sequence: Synthetic oligonucleotide
aagataccagtatactctctgg

SEQ ID NO: 1244 - DNA, 23 bp, Artificial Sequence
  Description of Artificial Sequence: Synthetic oligonucleotide
aagatccctgaacaacaccaaag

SEQ ID NO: 1245 - DNA, 23 bp, Artificial Sequence
  Description of Artificial Sequence: Synthetic oligonucleotide
aagataccagtcccaccctcttg

SEQ ID NO: 1246 - DNA, 24 bp, Artificial Sequence
  Description of Artificial Sequence: Synthetic oligonucleotide
tagatactctcaatgaccctctga

SEQ ID NO: 1247 - DNA, 23 bp, Artificial Sequence
  Description of Artificial Sequence: Synthetic oligonucleotide
aagttacttaaatagctctctgc

SEQ ID NO: 1248 - DNA, 23 bp, Artificial Sequence
  Description of Artificial Sequence: Synthetic oligonucleotide
aagatgcttgaatttccctaatg

SEQ ID NO: 1249 - DNA, 23 bp, Artificial Sequence
  Description of Artificial Sequence: Synthetic oligonucleotide
aagagatctggatcacccccagc

SEQ ID NO: 1250 - DNA, 23 bp, Artificial Sequence
  Description of Artificial Sequence: Synthetic oligonucleotide
aagatatttgaatattccctagg

SEQ ID NO: 1251 - DNA, 23 bp, Artificial Sequence
  Description of Artificial Sequence: Synthetic oligonucleotide
taattaccagaataaccctatga

SEQ ID NO: 1252 - DNA, 22 bp, Artificial Sequence
  Description of Artificial Sequence: Synthetic oligonucleotide
aagatacctgaaatacctgggt

SEQ ID NO: 1253 - DNA, 23 bp, Artificial Sequence
  Description of Artificial Sequence: Synthetic oligonucleotide
aaggtacctgagtaaacattctg

SEQ ID NO: 1254 - DNA, 22 bp, Artificial Sequence
  Description of Artificial Sequence: Synthetic oligonucleotide
aagatacatgaatgaattcagg

SEQ ID NO: 1255 - DNA, 22 bp, Artificial Sequence
  Description of Artificial Sequence: Synthetic oligonucleotide
cagatacctaagaaccctgacg

SEQ ID NO: 1256 - DNA, 23 bp, Artificial Sequence
  Description of Artificial Sequence: Synthetic oligonucleotide
agtataacagaataaccctatgt

SEQ ID NO: 1257 - DNA, 23 bp, Artificial Sequence
  Description of Artificial Sequence: Synthetic oligonucleotide
aacatatctgaatatctctctaa

SEQ ID NO: 1258 - DNA, 22 bp, Artificial Sequence
  Description of Artificial Sequence: Synthetic oligonucleotide
aagatcctgcctcaacctctgg

SEQ ID NO: 1259 - DNA, 23 bp, Artificial Sequence
  Description of Artificial Sequence: Synthetic oligonucleotide
aagataccaagctaatcctctgc

SEQ ID NO: 1260 - DNA, 23 bp, Artificial Sequence
  Description of Artificial Sequence: Synthetic oligonucleotide
gagatttctgaataacccaccct

SEQ ID NO: 1261 - DNA, 23 bp, Artificial Sequence
  Description of Artificial Sequence: Synthetic oligonucleotide
gagaggcctgagtagcccacggg

SEQ ID NO: 1262 - DNA, 23 bp, Artificial Sequence
  Description of Artificial Sequence: Synthetic oligonucleotide
aaggaaactggagaactctccgg

SEQ ID NO: 1263 - DNA, 23 bp, Artificial Sequence
  Description of Artificial Sequence: Synthetic oligonucleotide
aagatacttgaataaccatttca

SEQ ID NO: 1264 - DNA, 23 bp, Artificial Sequence
  Description of Artificial Sequence: Synthetic oligonucleotide
tgcttacatgaataaccctccag

SEQ ID NO: 1265 - DNA, 23 bp, Artificial Sequence
  Description of Artificial Sequence: Synthetic oligonucleotide
tctgtacctggataaccccctgg

SEQ ID NO: 1266 - DNA, 23 bp, Artificial Sequence
  Description of Artificial Sequence: Synthetic oligonucleotide
aaggtaactgacaaaccatctga

SEQ ID NO: 1267 - DNA, 23 bp, Artificial Sequence
  Description of Artificial Sequence: Synthetic oligonucleotide
aaaataaatgaataaaactgtgg

SEQ ID NO: 1268 - DNA, 23 bp, Artificial Sequence
  Description of Artificial Sequence: Synthetic oligonucleotide
aagtcaccagtttaacactcagg

SEQ ID NO: 1269 - DNA, 25 bp, Artificial Sequence
  Description of Artificial Sequence: Synthetic oligonucleotide
aagataccagaataaatcattctag

SEQ ID NO: 1270 - DNA, 23 bp, Artificial Sequence
  Description of Artificial Sequence: Synthetic oligonucleotide
taaatacatgaataaccattagg

SEQ ID NO: 1271 - DNA, 23 bp, Artificial Sequence
  Description of Artificial Sequence: Synthetic oligonucleotide
aaaagccctgatcaaacctcagg

SEQ ID NO: 1272 - DNA, 22 bp, Artificial Sequence
  Description of Artificial Sequence: Synthetic oligonucleotide
cacttacctgtataacctcagg

SEQ ID NO: 1273 - DNA, 23 bp, Artificial Sequence
  Description of Artificial Sequence: Synthetic oligonucleotide
aagatacttgcagaaccatctga

SEQ ID NO: 1274 - DNA, 21 bp, Artificial Sequence
  Description of Artificial Sequence: Synthetic oligonucleotide
aagatctgaatttccatcagg

SEQ ID NO: 1275 - DNA, 24 bp, Artificial Sequence
  Description of Artificial Sequence: Synthetic oligonucleotide
aagatatacatactaaccctctgg

SEQ ID NO: 1276 - DNA, 22 bp, Artificial Sequence
  Description of Artificial Sequence: Synthetic oligonucleotide
gagtaccataataaacctcagg

SEQ ID NO: 1277 - DNA, 23 bp, Artificial Sequence
  Description of Artificial Sequence: Synthetic oligonucleotide
aaagaacctaaataagcctcttg

SEQ ID NO: 1278 - DNA, 23 bp, Artificial Sequence
  Description of Artificial Sequence: Synthetic oligonucleotide
aagacattaaaataacccacagg

SEQ ID NO: 1279 - DNA, 23 bp, Artificial Sequence
  Description of Artificial Sequence: Synthetic oligonucleotide
aatatacctggaaaacccacacc

SEQ ID NO: 1280 - DNA, 23 bp, Artificial Sequence
  Description of Artificial Sequence: Synthetic oligonucleotide
aagacacatgaatatcactaatg

SEQ ID NO: 1281 - DNA, 22 bp, Artificial Sequence
  Description of Artificial Sequence: Synthetic oligonucleotide
aagatattgaataacccacatt

SEQ ID NO: 1282 - DNA, 23 bp, Artificial Sequence
  Description of Artificial Sequence: Synthetic oligonucleotide
aacatcccagaatgacccacagc

SEQ ID NO: 1283 - DNA, 23 bp, Artificial Sequence
  Description of Artificial Sequence: Synthetic oligonucleotide
aagaaagctggctagctctctgg

SEQ ID NO: 1284 - DNA, 24 bp, Artificial Sequence
  Description of Artificial Sequence: Synthetic oligonucleotide
aagataactgacttgaccctgtgg

SEQ ID NO: 1285 - DNA, 21 bp, Artificial Sequence
  Description of Artificial Sequence: Synthetic oligonucleotide
aagatatgaataaaactctgg

SEQ ID NO: 1286 - DNA, 23 bp, Artificial Sequence
  Description of Artificial Sequence: Synthetic oligonucleotide
aagctatctgagaaacccttttg

SEQ ID NO: 1287 - DNA, 22 bp, Artificial Sequence
  Description of Artificial Sequence: Synthetic oligonucleotide
cagatacctaataaccacacgg

SEQ ID NO: 1288 - DNA, 23 bp, Artificial Sequence
  Description of Artificial Sequence: Synthetic oligonucleotide
aagatacctgaaattatttcagg

SEQ ID NO: 1289 - DNA, 22 bp, Artificial Sequence
  Description of Artificial Sequence: Synthetic oligonucleotide
ttgatacctaaataccctgtgg

SEQ ID NO: 1290 - DNA, 23 bp, Artificial Sequence
  Description of Artificial Sequence: Synthetic oligonucleotide
taaatacatgaataatcctcggg

SEQ ID NO: 1291 - DNA, 23 bp, Artificial Sequence
  Description of Artificial Sequence: Synthetic oligonucleotide
aattaacctacataaccctcagt

SEQ ID NO: 1292 - DNA, 23 bp, Artificial Sequence
  Description of Artificial Sequence: Synthetic oligonucleotide
aagattcttaaataacccacttt

SEQ ID NO: 1293 - DNA, 23 bp, Artificial Sequence
  Description of Artificial Sequence: Synthetic oligonucleotide
aagatttaagaatgaacctcagg

SEQ ID NO: 1294 - DNA, 22 bp, Artificial Sequence
  Description of Artificial Sequence: Synthetic oligonucleotide
tggatacctgtcaaccctctgg

SEQ ID NO: 1295 - DNA, 23 bp, Artificial Sequence
  Description of Artificial Sequence: Synthetic oligonucleotide
aagatccgtgaataaaccacagc

SEQ ID NO: 1296 - DNA, 23 bp, Artificial Sequence
  Description of Artificial Sequence: Synthetic oligonucleotide
aacatacacgaatacctcacagg

SEQ ID NO: 1297 - DNA, 22 bp, Artificial Sequence
  Description of Artificial Sequence: Synthetic oligonucleotide
aagatgataaacaaccctctgg

SEQ ID NO: 1298 - DNA, 22 bp, Artificial Sequence
  Description of Artificial Sequence: Synthetic oligonucleotide
tagatcctaattaaccctcaga

SEQ ID NO: 1299 - DNA, 23 bp, Artificial Sequence
  Description of Artificial Sequence: Synthetic oligonucleotide
aagatacaggtgtagccctcctg

SEQ ID NO: 1300 - DNA, 23 bp, Artificial Sequence
  Description of Artificial Sequence: Synthetic oligonucleotide
ctgatatgtgaaaaaccctaagg

SEQ ID NO: 1301 - DNA, 22 bp, Artificial Sequence
  Description of Artificial Sequence: Synthetic oligonucleotide
aacatactgaaccagcctctgg

SEQ ID NO: 1302 - DNA, 23 bp, Artificial Sequence
  Description of Artificial Sequence: Synthetic oligonucleotide
aagacacgagaagaaccttctga

SEQ ID NO: 1303 - DNA, 23 bp, Artificial Sequence
  Description of Artificial Sequence: Synthetic oligonucleotide
aagacacttgaataccactcttt

SEQ ID NO: 1304 - DNA, 23 bp, Artificial Sequence
  Description of Artificial Sequence: Synthetic oligonucleotide
tacataccttgataaccttcagg

SEQ ID NO: 1305 - DNA, 23 bp, Artificial Sequence
  Description of Artificial Sequence: Synthetic oligonucleotide
aagttacctgaacaaacctgcaa

SEQ ID NO: 1306 - DNA, 23 bp, Artificial Sequence
  Description of Artificial Sequence: Synthetic oligonucleotide
aaaaaactagaagaaccctttgg

SEQ ID NO: 1307 - DNA, 23 bp, Artificial Sequence
  Description of Artificial Sequence: Synthetic oligonucleotide
aagatccctgaatttccatcaga

SEQ ID NO: 1308 - DNA, 22 bp, Artificial Sequence
  Description of Artificial Sequence: Synthetic oligonucleotide
aaaatacctgcataccctcagg

SEQ ID NO: 1309 - DNA, 23 bp, Artificial Sequence
  Description of Artificial Sequence: Synthetic oligonucleotide
aacttacatgaattactcttagg

SEQ ID NO: 1310 - DNA, 23 bp, Artificial Sequence
  Description of Artificial Sequence: Synthetic oligonucleotide
aacatttctcaatatccctttgg

SEQ ID NO: 1311 - DNA, 23 bp, Artificial Sequence
  Description of Artificial Sequence: Synthetic oligonucleotide
cagataactgaataaccctctgt

SEQ ID NO: 1312 - DNA, 21 bp, Artificial Sequence
  Description of Artificial Sequence: Synthetic oligonucleotide
taaatacctataacccactgg

SEQ ID NO: 1313 - DNA, 23 bp, Artificial Sequence
  Description of Artificial Sequence: Synthetic oligonucleotide
gagatacctgaatattcttccaa

SEQ ID NO: 1314 - DNA, 22 bp, Artificial Sequence
  Description of Artificial Sequence: Synthetic oligonucleotide
attatatctgaatatcctctgg

SEQ ID NO: 1315 - DNA, 22 bp, Artificial Sequence
  Description of Artificial Sequence: Synthetic oligonucleotide
atgatacccaatacccctccag

SEQ ID NO: 1316 - DNA, 23 bp, Artificial Sequence
  Description of Artificial Sequence: Synthetic oligonucleotide
cagatacctgaatctccttcttt

SEQ ID NO: 1317 - DNA, 23 bp, Artificial Sequence
  Description of Artificial Sequence: Synthetic oligonucleotide
cagttacctggataactccctgg

SEQ ID NO: 1318 - DNA, 23 bp, Artificial Sequence
  Description of Artificial Sequence: Synthetic oligonucleotide
aaaatactagaataaccagcttg

SEQ ID NO: 1319 - DNA, 23 bp, Artificial Sequence
  Description of Artificial Sequence: Synthetic oligonucleotide
aagactcaggaatatcactcagg

SEQ ID NO: 1320 - DNA, 22 bp, Artificial Sequence
  Description of Artificial Sequence: Synthetic oligonucleotide
aagatccagaagaatcatctgg

SEQ ID NO: 1321 - DNA, 23 bp, Artificial Sequence
  Description of Artificial Sequence: Synthetic oligonucleotide
aaaacacctgaataaatcccatg

SEQ ID NO: 1322 - DNA, 23 bp, Artificial Sequence
  Description of Artificial Sequence: Synthetic oligonucleotide
aacatcactgaagaaccctgaag

SEQ ID NO: 1323 - DNA, 22 bp, Artificial Sequence
  Description of Artificial Sequence: Synthetic oligonucleotide
aaaatacctcatagccctctgc

SEQ ID NO: 1324 - DNA, 23 bp, Artificial Sequence
  Description of Artificial Sequence: Synthetic oligonucleotide
aaaatagcttaataatgctcagt

SEQ ID NO: 1325 - DNA, 23 bp, Artificial Sequence
  Description of Artificial Sequence: Synthetic oligonucleotide
aagttccctgaacacacctctgg

SEQ ID NO: 1326 - DNA, 22 bp, Artificial Sequence
  Description of Artificial Sequence: Synthetic oligonucleotide
actatactgactaaccctctag

SEQ ID NO: 1327 - DNA, 23 bp, Artificial Sequence
  Description of Artificial Sequence: Synthetic oligonucleotide
agaatatcttcataaccttcggg

SEQ ID NO: 1328 - DNA, 22 bp, Artificial Sequence
  Description of Artificial Sequence: Synthetic oligonucleotide
agaaaacctgaataacctatgg

SEQ ID NO: 1329 - DNA, 23 bp, Artificial Sequence
  Description of Artificial Sequence: Synthetic oligonucleotide
aagatattcaaataaccctgctg

SEQ ID NO: 1330 - DNA, 22 bp, Artificial Sequence
  Description of Artificial Sequence: Synthetic oligonucleotide
gagatactgaataacctctggg

SEQ ID NO: 1331 - DNA, 22 bp, Artificial Sequence
  Description of Artificial Sequence: Synthetic oligonucleotide
aagatagctgctaaccctgagt

SEQ ID NO: 1332 - DNA, 23 bp, Artificial Sequence
  Description of Artificial Sequence: Synthetic oligonucleotide
aaaataaatgaataaccatcaga

SEQ ID NO: 1333 - DNA, 22 bp, Artificial Sequence
  Description of Artificial Sequence: Synthetic oligonucleotide
aaggtactagaaaaccctgtgg

SEQ ID NO: 1334 - DNA, 22 bp, Artificial Sequence
  Description of Artificial Sequence: Synthetic oligonucleotide
aagacactgccaaaccctccgg

SEQ ID NO: 1335 - DNA, 23 bp, Artificial Sequence
  Description of Artificial Sequence: Synthetic oligonucleotide
aagatacatgaatggccaacgcg

SEQ ID NO: 1336 - DNA, 23 bp, Artificial Sequence
  Description of Artificial Sequence: Synthetic oligonucleotide
cagagacctgcatagcactgagg

SEQ ID NO: 1337 - DNA, 23 bp, Artificial Sequence
  Description of Artificial Sequence: Synthetic oligonucleotide
aagatatctgaaaatccctgcgc

SEQ ID NO: 1338 - DNA, 24 bp, Artificial Sequence
  Description of Artificial Sequence: Synthetic oligonucleotide
aagaacactgagaaaaccctctgg

SEQ ID NO: 1339 - DNA, 23 bp, Artificial Sequence
  Description of Artificial Sequence: Synthetic oligonucleotide
aagaaacctccatatccatcgtg

SEQ ID NO: 1340 - DNA, 23 bp, Artificial Sequence
  Description of Artificial Sequence: Synthetic oligonucleotide
aaggtaccttaacaacattttgg

SEQ ID NO: 1341 - DNA, 23 bp, Artificial Sequence
  Description of Artificial Sequence: Synthetic oligonucleotide
aaggtgactgaaggacccttggg

SEQ ID NO: 1342 - DNA, 23 bp, Artificial Sequence
  Description of Artificial Sequence: Synthetic oligonucleotide
acgataactgaacagctctcaag

SEQ ID NO: 1343 - DNA, 23 bp, Artificial Sequence
  Description of Artificial Sequence: Synthetic oligonucleotide
aagagggcttaataaccttcaag

SEQ ID NO: 1344 - DNA, 23 bp, Artificial Sequence
  Description of Artificial Sequence: Synthetic oligonucleotide
aagataactggatagctctatga

SEQ ID NO: 1345 - DNA, 22 bp, Artificial Sequence
  Description of Artificial Sequence: Synthetic oligonucleotide
aagattcagcaataccctctgg

SEQ ID NO: 1346 - DNA, 22 bp, Artificial Sequence
  Description of Artificial Sequence: Synthetic oligonucleotide
caaaaaccagaaaaccctcagg

SEQ ID NO: 1347 - DNA, 23 bp, Artificial Sequence
  Description of Artificial Sequence: Synthetic oligonucleotide
catataccaaaataacccatggg

SEQ ID NO: 1348 - DNA, 21 bp, Artificial Sequence
  Description of Artificial Sequence: Synthetic oligonucleotide
aaaatacaaataaccctcaga

SEQ ID NO: 1349 - DNA, 23 bp, Artificial Sequence
  Description of Artificial Sequence: Synthetic oligonucleotide
aaaatacctgaataaacctgaag

SEQ ID NO: 1350 - DNA, 23 bp, Artificial Sequence
  Description of Artificial Sequence: Synthetic oligonucleotide
aagataacttaataggcctccac

SEQ ID NO: 1351 - DNA, 23 bp, Artificial Sequence
  Description of Artificial Sequence: Synthetic oligonucleotide
aagatggctgaaaaagcctttcg

SEQ ID NO: 1352 - DNA, 22 bp, Artificial Sequence
  Description of Artificial Sequence: Synthetic oligonucleotide
aagttaccagataacccacagg

SEQ ID NO: 1353 - DNA, 23 bp, Artificial Sequence
  Description of Artificial Sequence: Synthetic oligonucleotide
cagatacctggttaaacatcacg

SEQ ID NO: 1354 - DNA, 23 bp, Artificial Sequence
  Description of Artificial Sequence: Synthetic oligonucleotide
aagatacatgaatggccaacagg

SEQ ID NO: 1355 - DNA, 23 bp, Artificial Sequence
  Description of Artificial Sequence: Synthetic oligonucleotide
aagctaccagcatagcccactag

SEQ ID NO: 1356 - DNA, 23 bp, Artificial Sequence
  Description of Artificial Sequence: Synthetic oligonucleotide
aagaaagctggaaaacactccag

SEQ ID NO: 1357 - DNA, 23 bp, Artificial Sequence
  Description of Artificial Sequence: Synthetic oligonucleotide
aagatgcctgagtctcccccgtg

SEQ ID NO: 1358 - DNA, 23 bp, Artificial Sequence
  Description of Artificial Sequence: Synthetic oligonucleotide
aaggaaactgaataaccctcaga

SEQ ID NO: 1359 - DNA, 23 bp, Artificial Sequence
  Description of Artificial Sequence: Synthetic oligonucleotide
ctgagaactgaataaacctcgag

SEQ ID NO: 1360 - DNA, 23 bp, Artificial Sequence
  Description of Artificial Sequence: Synthetic oligonucleotide
aaggttacagaataaaactctgg

SEQ ID NO: 1361 - DNA, 23 bp, Artificial Sequence
  Description of Artificial Sequence: Synthetic oligonucleotide
caggatactgaataaccctcaga

SEQ ID NO: 1362 - DNA, 23 bp, Artificial Sequence
  Description of Artificial Sequence: Synthetic oligonucleotide
ccattacatgaataaccttcagg

SEQ ID NO: 1363 - DNA, 23 bp, Artificial Sequence
  Description of Artificial Sequence: Synthetic oligonucleotide
aagacacctggataaccatcagg

SEQ ID NO: 1364 - DNA, 21 bp, Artificial Sequence
  Description of Artificial Sequence: Synthetic oligonucleotide
aaattatgaaaaaccctcagg

SEQ ID NO: 1365 - DNA, 22 bp, Artificial Sequence
  Description of Artificial Sequence: Synthetic oligonucleotide
aagatacttgacaactctctga

SEQ ID NO: 1366 - DNA, 23 bp, Artificial Sequence
  Description of Artificial Sequence: Synthetic oligonucleotide
aagatagatgaatgacccactac

SEQ ID NO: 1367 - DNA, 23 bp, Artificial Sequence
  Description of Artificial Sequence: Synthetic oligonucleotide
aagatacttaaatgatccttggc

SEQ ID NO: 1368 - DNA, 23 bp, Artificial Sequence
  Description of Artificial Sequence: Synthetic oligonucleotide
aatatacctaaataacttacagc

SEQ ID NO: 1369 - DNA, 23 bp, Artificial Sequence
  Description of Artificial Sequence: Synthetic oligonucleotide
aagataactggatagccatatgc

SEQ ID NO: 1370 - DNA, 23 bp, Artificial Sequence
  Description of Artificial Sequence: Synthetic oligonucleotide
aacaaacatgaaaaacactcagc

SEQ ID NO: 1371 - DNA, 23 bp, Artificial Sequence
  Description of Artificial Sequence: Synthetic oligonucleotide
aagatacctaaatatatatctga

SEQ ID NO: 1372 - DNA, 23 bp, Artificial Sequence
  Description of Artificial Sequence: Synthetic oligonucleotide
aggatgactgaaaaatccccagg

SEQ ID NO: 1373 - DNA, 23 bp, Artificial Sequence
  Description of Artificial Sequence: Synthetic oligonucleotide
aagatgactgcttaacccccagt

SEQ ID NO: 1374 - DNA, 23 bp, Artificial Sequence
  Description of Artificial Sequence: Synthetic oligonucleotide
aagataccaaaatgtaactcagg

SEQ ID NO: 1375 - DNA, 23 bp, Artificial Sequence
  Description of Artificial Sequence: Synthetic oligonucleotide
aagataacttaaaaactctaagg

SEQ ID NO: 1376 - DNA, 23 bp, Artificial Sequence
  Description of Artificial Sequence: Synthetic oligonucleotide
acagaacctgaatagccctaggg

SEQ ID NO: 1377 - DNA, 24 bp, Artificial Sequence
  Description of Artificial Sequence: Synthetic oligonucleotide
aagatgcctgaactagtccttggg

SEQ ID NO: 1378 - DNA, 22 bp, Artificial Sequence
  Description of Artificial Sequence: Synthetic oligonucleotide
aaaataactgaaaaccctcaac

SEQ ID NO: 1379 - DNA, 23 bp, Artificial Sequence
  Description of Artificial Sequence: Synthetic oligonucleotide
aacatacatccacaaccatcagg

SEQ ID NO: 1380 - DNA, 23 bp, Artificial Sequence
  Description of Artificial Sequence: Synthetic oligonucleotide
aagatacatgaataagcaccatg

SEQ ID NO: 1381 - DNA, 23 bp, Artificial Sequence
  Description of Artificial Sequence: Synthetic oligonucleotide
catatacttgaataaccaactgg

SEQ ID NO: 1382 - DNA, 21 bp, Artificial Sequence
  Description of Artificial Sequence: Synthetic oligonucleotide
aagatcttaataatcatctgg

SEQ ID NO: 1383 - DNA, 21 bp, Artificial Sequence
  Description of Artificial Sequence: Synthetic oligonucleotide
aagaaacccgagtccctctgg

SEQ ID NO: 1384 - DNA, 22 bp, Artificial Sequence
  Description of Artificial Sequence: Synthetic oligonucleotide
aagatatctcatatcactcagg

SEQ ID NO: 1385 - DNA, 24 bp, Artificial Sequence
  Description of Artificial Sequence: Synthetic oligonucleotide
acaataccttgaataacccacaag

SEQ ID NO: 1386 - DNA, 23 bp, Artificial Sequence
  Description of Artificial Sequence: Synthetic oligonucleotide
aagatacataaataacctcacag

SEQ ID NO: 1387 - DNA, 22 bp, Artificial Sequence
  Description of Artificial Sequence: Synthetic oligonucleotide
aagtaacagaataatcctaagg

SEQ ID NO: 1388 - DNA, 23 bp, Artificial Sequence
  Description of Artificial Sequence: Synthetic oligonucleotide
gaataacctgaataacccccaga

SEQ ID NO: 1389 - DNA, 23 bp, Artificial Sequence
  Description of Artificial Sequence: Synthetic oligonucleotide
aaattacctaaataacccaaggc

SEQ ID NO: 1390 - DNA, 23 bp, Artificial Sequence
  Description of Artificial Sequence: Synthetic oligonucleotide
aaggtacctgaatattgttctgt

SEQ ID NO: 1391 - DNA, 23 bp, Artificial Sequence
  Description of Artificial Sequence: Synthetic oligonucleotide
aagacagctgggtatctctctgg

SEQ ID NO: 1392 - DNA, 22 bp, Artificial Sequence
  Description of Artificial Sequence: Synthetic oligonucleotide
ctgatagtgaataagcctcagg

SEQ ID NO: 1393 - DNA, 22 bp, Artificial Sequence
  Description of Artificial Sequence: Synthetic oligonucleotide
atgatagtgaataagtctcagg

SEQ ID NO: 1394 - DNA, 23 bp, Artificial Sequence
  Description of Artificial Sequence: Synthetic oligonucleotide
tagatatttgaataaccatttag

SEQ ID NO: 1395 - DNA, 24 bp, Artificial Sequence
  Description of Artificial Sequence: Synthetic oligonucleotide
aagatgccctgagcaaccctcctg

SEQ ID NO: 1396 - DNA, 23 bp, Artificial Sequence
  Description of Artificial Sequence: Synthetic oligonucleotide
atgatctctgaatggccttcagg

SEQ ID NO: 1397 - DNA, 23 bp, Artificial Sequence
  Description of Artificial Sequence: Synthetic oligonucleotide
cgtgtacctgaatgacccacggg

SEQ ID NO: 1398 - DNA, 22 bp, Artificial Sequence
  Description of Artificial Sequence: Synthetic oligonucleotide
tagatactgagaaagcctctgg

SEQ ID NO: 1399 - DNA, 22 bp, Artificial Sequence
  Description of Artificial Sequence: Synthetic oligonucleotide
aagttatctaaaaaccctctag

SEQ ID NO: 1400 - DNA, 23 bp, Artificial Sequence
  Description of Artificial Sequence: Synthetic oligonucleotide
aagatatctgaaaaattctcaaa

SEQ ID NO: 1401 - DNA, 22 bp, Artificial Sequence
  Description of Artificial Sequence: Synthetic oligonucleotide
aagtaaactgaaaaccttctgg

SEQ ID NO: 1402 - DNA, 23 bp, Artificial Sequence
  Description of Artificial Sequence: Synthetic oligonucleotide
aatataactgaataaaactcttt

SEQ ID NO: 1403 - DNA, 22 bp, Artificial Sequence
  Description of Artificial Sequence: Synthetic oligonucleotide
tagctacatgaaaaccctgggg

SEQ ID NO: 1404 - DNA, 22 bp, Artificial Sequence
  Description of Artificial Sequence: Synthetic oligonucleotide
ataatactgaataaccctttga

SEQ ID NO: 1405 - DNA, 22 bp, Artificial Sequence
  Description of Artificial Sequence: Synthetic oligonucleotide
cttttacctgaataccctcagg

SEQ ID NO: 1406 - DNA, 23 bp, Artificial Sequence
  Description of Artificial Sequence: Synthetic oligonucleotide
aagatgactgaagagcccttggg

SEQ ID NO: 1407 - DNA, 23 bp, Artificial Sequence
  Description of Artificial Sequence: Synthetic oligonucleotide
atgagcccagaagaaccctcttg

SEQ ID NO: 1408 - DNA, 23 bp, Artificial Sequence
  Description of Artificial Sequence: Synthetic oligonucleotide
gagatacctgaaaaatcctggct

SEQ ID NO: 1409 - DNA, 23 bp, Artificial Sequence
  Description of Artificial Sequence: Synthetic oligonucleotide
tgtataccagaatcaccctaggg

SEQ ID NO: 1410 - DNA, 22 bp, Artificial Sequence
  Description of Artificial Sequence: Synthetic oligonucleotide
cagatacctggtaactctcagg

SEQ ID NO: 1411 - DNA, 23 bp, Artificial Sequence
  Description of Artificial Sequence: Synthetic oligonucleotide
aaattacctggacaaccttcgcg

SEQ ID NO: 1412 - DNA, 23 bp, Artificial Sequence
  Description of Artificial Sequence: Synthetic oligonucleotide
aagatacatgaataaccttgtca

SEQ ID NO: 1413 - DNA, 22 bp, Artificial Sequence
  Description of Artificial Sequence: Synthetic oligonucleotide
aagatacattagaaccctctgt

SEQ ID NO: 1414 - DNA, 23 bp, Artificial Sequence
  Description of Artificial Sequence: Synthetic oligonucleotide
aagatatatgaatggccctgaag

SEQ ID NO: 1415 - DNA, 23 bp, Artificial Sequence
  Description of Artificial Sequence: Synthetic oligonucleotide
aagatacacaaacagcccacagg

SEQ ID NO: 1416 - DNA, 23 bp, Artificial Sequence
  Description of Artificial Sequence: Synthetic oligonucleotide
aacatacctgaaaaaacctcagc

SEQ ID NO: 1417 - DNA, 23 bp, Artificial Sequence
  Description of Artificial Sequence: Synthetic oligonucleotide
aggattccagaagaagcctgtgg

SEQ ID NO: 1418 - DNA, 23 bp, Artificial Sequence
  Description of Artificial Sequence: Synthetic oligonucleotide
aagaaacctggatttacctctgt

SEQ ID NO: 1419 - DNA, 23 bp, Artificial Sequence
  Description of Artificial Sequence: Synthetic oligonucleotide
agaatagctgaaggaccctgggg

SEQ ID NO: 1420 - DNA, 23 bp, Artificial Sequence
  Description of Artificial Sequence: Synthetic oligonucleotide
aggatgccagggtaacccactgg

SEQ ID NO: 1421 - DNA, 22 bp, Artificial Sequence
  Description of Artificial Sequence: Synthetic oligonucleotide
taggtacctgaatgacctcagg

SEQ ID NO: 1422 - DNA, 23 bp, Artificial Sequence
  Description of Artificial Sequence: Synthetic oligonucleotide
aagatacctgacataccctcccc

SEQ ID NO: 1423 - DNA, 23 bp, Artificial Sequence
  Description of Artificial Sequence: Synthetic oligonucleotide
gagatacatgaatgaccctttca

SEQ ID NO: 1424 - DNA, 22 bp, Artificial Sequence
  Description of Artificial Sequence: Synthetic oligonucleotide
gtgatagtgaataactctcagg

SEQ ID NO: 1425 - DNA, 23 bp, Artificial Sequence
  Description of Artificial Sequence: Synthetic oligonucleotide
aggaaagctgaataactctctta

SEQ ID NO: 1426 - DNA, 23 bp, Artificial Sequence
  Description of Artificial Sequence: Synthetic oligonucleotide
aagaaacgctaataaacctcagg

SEQ ID NO: 1427 - DNA, 23 bp, Artificial Sequence
  Description of Artificial Sequence: Synthetic oligonucleotide
aacattccacactaaccatcagg

SEQ ID NO: 1428 - DNA, 23 bp, Artificial Sequence
  Description of Artificial Sequence: Synthetic oligonucleotide
aagatacgagagaaacgcccggg

SEQ ID NO: 1429 - DNA, 23 bp, Artificial Sequence
  Description of Artificial Sequence: Synthetic oligonucleotide
caattaccagaataacccacaga

SEQ ID NO: 1430 - DNA, 22 bp, Artificial Sequence
  Description of Artificial Sequence: Synthetic oligonucleotide
aagagatttgataaccttctgg

SEQ ID NO: 1431 - DNA, 23 bp, Artificial Sequence
  Description of Artificial Sequence: Synthetic oligonucleotide
aagattcctgattcagcctctga

SEQ ID NO: 1432 - DNA, 23 bp, Artificial Sequence
  Description of Artificial Sequence: Synthetic oligonucleotide
aagaagccagactaacactgggg

SEQ ID NO: 1433 - DNA, 23 bp, Artificial Sequence
  Description of Artificial Sequence: Synthetic oligonucleotide
caaataaatgaataatcatcagg

SEQ ID NO: 1434 - DNA, 23 bp, Artificial Sequence
  Description of Artificial Sequence: Synthetic oligonucleotide
aagaggcctgactctccctccag

SEQ ID NO: 1435 - DNA, 23 bp, Artificial Sequence
  Description of Artificial Sequence: Synthetic oligonucleotide
aagatacttgtataacctcaaga

SEQ ID NO: 1436 - DNA, 23 bp, Artificial Sequence
  Description of Artificial Sequence: Synthetic oligonucleotide
aacatacctgaacaaccctcagg

SEQ ID NO: 1437 - DNA, 23 bp, Artificial Sequence
  Description of Artificial Sequence: Synthetic oligonucleotide
aagatatttatatacccctccag

SEQ ID NO: 1438 - DNA, 23 bp, Artificial Sequence
  Description of Artificial Sequence: Synthetic oligonucleotide
tagttacatgaagaaacctctag

SEQ ID NO: 1439 - DNA, 24 bp, Artificial Sequence
  Description of Artificial Sequence: Synthetic oligonucleotide
aagatacatgcgtgaagcctctgg

SEQ ID NO: 1440 - DNA, 23 bp, Artificial Sequence
  Description of Artificial Sequence: Synthetic oligonucleotide
atggtacctgtacaaacttcagg

SEQ ID NO: 1441 - DNA, 22 bp, Artificial Sequence
  Description of Artificial Sequence: Synthetic oligonucleotide
aaggcacctgaaagctctctgg

SEQ ID NO: 1442 - DNA, 23 bp, Artificial Sequence
  Description of Artificial Sequence: Synthetic oligonucleotide
gagatacctggaaaaccccaggc

SEQ ID NO: 1443 - DNA, 23 bp, Artificial Sequence
  Description of Artificial Sequence: Synthetic oligonucleotide
atgttaacagaagacccctctgg

SEQ ID NO: 1444 - DNA, 23 bp, Artificial Sequence
  Description of Artificial Sequence: Synthetic oligonucleotide
tagataactggataccccactgc

SEQ ID NO: 1445 - DNA, 23 bp, Artificial Sequence
  Description of Artificial Sequence: Synthetic oligonucleotide
aaaattcctgtccagccctctgg

SEQ ID NO: 1446 - DNA, 23 bp, Artificial Sequence
  Description of Artificial Sequence: Synthetic oligonucleotide
aggatgcctgaaaaaacctcaaa

SEQ ID NO: 1447 - DNA, 22 bp, Artificial Sequence
  Description of Artificial Sequence: Synthetic oligonucleotide
aagatacatgagaaccctttgc

SEQ ID NO: 1448 - DNA, 23 bp, Artificial Sequence
  Description of Artificial Sequence: Synthetic oligonucleotide
aagatacatgaatagccctccac

SEQ ID NO: 1449 - DNA, 23 bp, Artificial Sequence
  Description of Artificial Sequence: Synthetic oligonucleotide
taaatacctgaataacccatagt

SEQ ID NO: 1450 - DNA, 23 bp, Artificial Sequence
  Description of Artificial Sequence: Synthetic oligonucleotide
tatatacatgtataacccacagg

SEQ ID NO: 1451 - DNA, 23 bp, Artificial Sequence
  Description of Artificial Sequence: Synthetic oligonucleotide
aagatacattcttagccctcaag

SEQ ID NO: 1452 - DNA, 23 bp, Artificial Sequence
  Description of Artificial Sequence: Synthetic oligonucleotide
aagaaaccttgtgaaccctcagt

SEQ ID NO: 1453 - DNA, 21 bp, Artificial Sequence
  Description of Artificial Sequence: Synthetic oligonucleotide
aagaaatggatagccctctgg

SEQ ID NO: 1454 - DNA, 23 bp, Artificial Sequence
  Description of Artificial Sequence: Synthetic oligonucleotide
aaaatagcttaaaaagcctgtgg

SEQ ID NO: 1455 - DNA, 23 bp, Artificial Sequence
  Description of Artificial Sequence: Synthetic oligonucleotide
agggtgccccaacaaccctcggg

SEQ ID NO: 1456 - DNA, 23 bp, Artificial Sequence
  Description of Artificial Sequence: Synthetic oligonucleotide
aagaaatgtgggtaagcctcagg

SEQ ID NO: 1457 - DNA, 23 bp, Artificial Sequence
  Description of Artificial Sequence: Synthetic oligonucleotide
atcatatctgaataactctcaac

SEQ ID NO: 1458 - DNA, 23 bp, Artificial Sequence
  Description of Artificial Sequence: Synthetic oligonucleotide
aacaagcctgtataaccctcatg

SEQ ID NO: 1459 - DNA, 22 bp, Artificial Sequence
  Description of Artificial Sequence: Synthetic oligonucleotide
gtgatactgaataagtctcagg

SEQ ID NO: 1460 - DNA, 23 bp, Artificial Sequence
  Description of Artificial Sequence: Synthetic oligonucleotide
aacatacatgaataatcttcaaa

SEQ ID NO: 1461 - DNA, 23 bp, Artificial Sequence
  Description of Artificial Sequence: Synthetic oligonucleotide
attatacctcaatatccctctgg

SEQ ID NO: 1462 - DNA, 23 bp, Artificial Sequence
  Description of Artificial Sequence: Synthetic oligonucleotide
aagatacatgaaaaacactggct

SEQ ID NO: 1463 - DNA, 23 bp, Artificial Sequence
  Description of Artificial Sequence: Synthetic oligonucleotide
aagatacctgtacaacactatac

SEQ ID NO: 1464 - DNA, 23 bp, Artificial Sequence
  Description of Artificial Sequence: Synthetic oligonucleotide
cagatacctcatttaccctgatg

SEQ ID NO: 1465 - DNA, 21 bp, Artificial Sequence
  Description of Artificial Sequence: Synthetic oligonucleotide
cagatacttataaccctctgg

SEQ ID NO: 1466 - DNA, 24 bp, Artificial Sequence
  Description of Artificial Sequence: Synthetic oligonucleotide
aaaatacttgaaaaatccctcagt

SEQ ID NO: 1467 - DNA, 22 bp, Artificial Sequence
  Description of Artificial Sequence: Synthetic oligonucleotide
aagatcaagaataactgtcagg

SEQ ID NO: 1468 - DNA, 23 bp, Artificial Sequence
  Description of Artificial Sequence: Synthetic oligonucleotide
aagacacttgtctagtcctctgg

SEQ ID NO: 1469 - DNA, 23 bp, Artificial Sequence
  Description of Artificial Sequence: Synthetic oligonucleotide
aagaatccggaaaaaccctatgc

SEQ ID NO: 1470 - DNA, 23 bp, Artificial Sequence
  Description of Artificial Sequence: Synthetic oligonucleotide
aagacagctggagaactctcagg

SEQ ID NO: 1471 - DNA, 23 bp, Artificial Sequence
  Description of Artificial Sequence: Synthetic oligonucleotide
aagaaaaatgaacaaacctcaga

SEQ ID NO: 1472 - DNA, 23 bp, Artificial Sequence
  Description of Artificial Sequence: Synthetic oligonucleotide
aagttacgtgaataggactcagt

SEQ ID NO: 1473 - DNA, 22 bp, Artificial Sequence
  Description of Artificial Sequence: Synthetic oligonucleotide
aagataaagaacaactctctgg

SEQ ID NO: 1474 - DNA, 23 bp, Artificial Sequence
  Description of Artificial Sequence: Synthetic oligonucleotide
cagatacacagataacccccagg

SEQ ID NO: 1475 - DNA, 22 bp, Artificial Sequence
  Description of Artificial Sequence: Synthetic oligonucleotide
aagaaacttgaaaaatcccagg

SEQ ID NO: 1476 - DNA, 23 bp, Artificial Sequence
  Description of Artificial Sequence: Synthetic oligonucleotide
cagataacagaaaaaccctgttg

SEQ ID NO: 1477 - DNA, 23 bp, Artificial Sequence
  Description of Artificial Sequence: Synthetic oligonucleotide
aagatacccagatccccctccag

SEQ ID NO: 1478 - DNA, 24 bp, Artificial Sequence
  Description of Artificial Sequence: Synthetic oligonucleotide
tagatattctgaatatacctctgg

SEQ ID NO: 1479 - DNA, 24 bp, Artificial Sequence
  Description of Artificial Sequence: Synthetic oligonucleotide
cagatacatgaaataatcctccag

SEQ ID NO: 1480 - DNA, 23 bp, Artificial Sequence
  Description of Artificial Sequence: Synthetic oligonucleotide
agtcatcctgaataaccctcatg

SEQ ID NO: 1481 - DNA, 22 bp, Artificial Sequence
  Description of Artificial Sequence: Synthetic oligonucleotide
gccataccaaataaccctctgg

SEQ ID NO: 1482 - DNA, 23 bp, Artificial Sequence
  Description of Artificial Sequence: Synthetic oligonucleotide
aagatacctggataagcaactgc

SEQ ID NO: 1483 - DNA, 23 bp, Artificial Sequence
  Description of Artificial Sequence: Synthetic oligonucleotide
aagaaacctatagaaccctgagt

SEQ ID NO: 1484 - DNA, 23 bp, Artificial Sequence
  Description of Artificial Sequence: Synthetic oligonucleotide
aagaaaacagaataaacctctaa

SEQ ID NO: 1485 - DNA, 23 bp, Artificial Sequence
  Description of Artificial Sequence: Synthetic oligonucleotide
aagataccttatcaaccctaaag

SEQ ID NO: 1486 - DNA, 23 bp, Artificial Sequence
  Description of Artificial Sequence: Synthetic oligonucleotide
cagaaatataaaaaaccctcagg

SEQ ID NO: 1487 - DNA, 23 bp, Artificial Sequence
  Description of Artificial Sequence: Synthetic oligonucleotide
aagattcaagaaagaccctctgc

SEQ ID NO: 1488 - DNA, 22 bp, Artificial Sequence
  Description of Artificial Sequence: Synthetic oligonucleotide
taaatactgaataaccctgtga

SEQ ID NO: 1489 - DNA, 23 bp, Artificial Sequence
  Description of Artificial Sequence: Synthetic oligonucleotide
gagatctcagcataactctctgg

SEQ ID NO: 1490 - DNA, 22 bp, Artificial Sequence
  Description of Artificial Sequence: Synthetic oligonucleotide
aagataccttatttacctatgg

SEQ ID NO: 1491 - DNA, 23 bp, Artificial Sequence
  Description of Artificial Sequence: Synthetic oligonucleotide
ttcatacctaaataacccttaga

SEQ ID NO: 1492 - DNA, 23 bp, Artificial Sequence
  Description of Artificial Sequence: Synthetic oligonucleotide
aagatacctgaataacctaagac

SEQ ID NO: 1493 - DNA, 22 bp, Artificial Sequence
  Description of Artificial Sequence: Synthetic oligonucleotide
aagatacataataatcatctgt

SEQ ID NO: 1494 - DNA, 23 bp, Artificial Sequence
  Description of Artificial Sequence: Synthetic oligonucleotide
aagagcccttgctaaccatctgg

SEQ ID NO: 1495 - DNA, 23 bp, Artificial Sequence
  Description of Artificial Sequence: Synthetic oligonucleotide
aaagtatctgaataacacttctg

SEQ ID NO: 1496 - DNA, 23 bp, Artificial Sequence
  Description of Artificial Sequence: Synthetic oligonucleotide
agcctacctaaatagccctaggg

SEQ ID NO: 1497 - DNA, 23 bp, Artificial Sequence
  Description of Artificial Sequence: Synthetic oligonucleotide
cagacacctgaatgaccccaggc

SEQ ID NO: 1498 - DNA, 23 bp, Artificial Sequence
  Description of Artificial Sequence: Synthetic oligonucleotide
cactgacctgaatcacccccagg

SEQ ID NO: 1499 - DNA, 22 bp, Artificial Sequence
  Description of Artificial Sequence: Synthetic oligonucleotide
gaaatactgaataatcctcagg

SEQ ID NO: 1500 - DNA, 23 bp, Artificial Sequence
  Description of Artificial Sequence: Synthetic oligonucleotide
aagacacagaaagatccctctgg

SEQ ID NO: 1501 - DNA, 23 bp, Artificial Sequence
  Description of Artificial Sequence: Synthetic oligonucleotide
aaggtaccagatgagcccttggg

SEQ ID NO: 1502 - DNA, 23 bp, Artificial Sequence
  Description of Artificial Sequence: Synthetic oligonucleotide
aggatacctcccaaatcctctgg

SEQ ID NO: 1503 - DNA, 23 bp, Artificial Sequence
  Description of Artificial Sequence: Synthetic oligonucleotide
caaatacttgaaaagccctcgag

SEQ ID NO: 1504 - DNA, 21 bp, Artificial Sequence
  Description of Artificial Sequence: Synthetic oligonucleotide
taaatatgaatgaccctcagg

SEQ ID NO: 1505 - DNA, 23 bp, Artificial Sequence
  Description of Artificial Sequence: Synthetic oligonucleotide
cagatatctgaagatccctccag

SEQ ID NO: 1506 - DNA, 23 bp, Artificial Sequence
  Description of Artificial Sequence: Synthetic oligonucleotide
acagaacctgtataaccctccag

SEQ ID NO: 1507 - DNA, 24 bp, Artificial Sequence
  Description of Artificial Sequence: Synthetic oligonucleotide
aagaaatctagaatacccctaggg

SEQ ID NO: 1508 - DNA, 25 bp, Artificial Sequence
  Description of Artificial Sequence: Synthetic oligonucleotide
aagttaaatgaatgaccctgaccgg

SEQ ID NO: 1509 - DNA, 23 bp, Artificial Sequence
  Description of Artificial Sequence: Synthetic oligonucleotide
aagatatttgatcaacccttgga

SEQ ID NO: 1510 - DNA, 23 bp, Artificial Sequence
  Description of Artificial Sequence: Synthetic oligonucleotide
aggtaacatcaatatccctccgg

SEQ ID NO: 1511 - DNA, 23 bp, Artificial Sequence
  Description of Artificial Sequence: Synthetic oligonucleotide
aacgtacctgaataactcataag

SEQ ID NO: 1512 - DNA, 23 bp, Artificial Sequence
  Description of Artificial Sequence: Synthetic oligonucleotide
aagataccagcatagtcctcctg

SEQ ID NO: 1513 - DNA, 23 bp, Artificial Sequence
  Description of Artificial Sequence: Synthetic oligonucleotide
aagatatctgaagagccttccca

SEQ ID NO: 1514 - DNA, 23 bp, Artificial Sequence
  Description of Artificial Sequence: Synthetic oligonucleotide
aagatacctgaatttaccatgag

SEQ ID NO: 1515 - DNA, 23 bp, Artificial Sequence
  Description of Artificial Sequence: Synthetic oligonucleotide
aagatactttattaactctcaag

SEQ ID NO: 1516 - DNA, 23 bp, Artificial Sequence
  Description of Artificial Sequence: Synthetic oligonucleotide
tagatatgtgaattaacttctgg

SEQ ID NO: 1517 - DNA, 23 bp, Artificial Sequence
  Description of Artificial Sequence: Synthetic oligonucleotide
aagatacctgatcacacatcaga

SEQ ID NO: 1518 - DNA, 23 bp, Artificial Sequence
  Description of Artificial Sequence: Synthetic oligonucleotide
cagatacctcaataaccctgatg

SEQ ID NO: 1519 - DNA, 23 bp, Artificial Sequence
  Description of Artificial Sequence: Synthetic oligonucleotide
aagatacttggataatgcttggt

SEQ ID NO: 1520 - DNA, 23 bp, Artificial Sequence
  Description of Artificial Sequence: Synthetic oligonucleotide
aaggtatctgaattaccctcaag

SEQ ID NO: 1521 - DNA, 23 bp, Artificial Sequence
  Description of Artificial Sequence: Synthetic oligonucleotide
ctgagacctgagtaactctcatg

SEQ ID NO: 1522 - DNA, 22 bp, Artificial Sequence
  Description of Artificial Sequence: Synthetic oligonucleotide
aagaaaatgaataaccctacag

SEQ ID NO: 1523 - DNA, 23 bp, Artificial Sequence
  Description of Artificial Sequence: Synthetic oligonucleotide
tagatacatgaaaaacccttcag

SEQ ID NO: 1524 - DNA, 23 bp, Artificial Sequence
  Description of Artificial Sequence: Synthetic oligonucleotide
tagatgcttaaatgaccctctgc

SEQ ID NO: 1525 - DNA, 23 bp, Artificial Sequence
  Description of Artificial Sequence: Synthetic oligonucleotide
taggatcctggataaccctccag

SEQ ID NO: 1526 - DNA, 23 bp, Artificial Sequence
  Description of Artificial Sequence: Synthetic oligonucleotide
ttgatacttgaataaccatctga

SEQ ID NO: 1527 - DNA, 21 bp, Artificial Sequence
  Description of Artificial Sequence: Synthetic oligonucleotide
aagaaaccaataaccctcagg

SEQ ID NO: 1528 - DNA, 23 bp, Artificial Sequence
  Description of Artificial Sequence: Synthetic oligonucleotide
aaggaaccagaattactctcagt

SEQ ID NO: 1529 - DNA, 23 bp, Artificial Sequence
  Description of Artificial Sequence: Synthetic oligonucleotide
cagaaaccagaataaccttcagg

SEQ ID NO: 1530 - DNA, 23 bp, Artificial Sequence
  Description of Artificial Sequence: Synthetic oligonucleotide
aaaattcctgaatagctctctgg

SEQ ID NO: 1531 - DNA, 22 bp, Artificial Sequence
  Description of Artificial Sequence: Synthetic oligonucleotide
atgatagtgaataacactcatg

SEQ ID NO: 1532 - DNA, 22 bp, Artificial Sequence
  Description of Artificial Sequence: Synthetic oligonucleotide
aggatacagaatatccatctgg

SEQ ID NO: 1533 - DNA, 23 bp, Artificial Sequence
  Description of Artificial Sequence: Synthetic oligonucleotide
aatctacctgaaaagccctctgg

SEQ ID NO: 1534 - DNA, 22 bp, Artificial Sequence
  Description of Artificial Sequence: Synthetic oligonucleotide
ctgataccagataaccctgagg

SEQ ID NO: 1535 - DNA, 23 bp, Artificial Sequence
  Description of Artificial Sequence: Synthetic oligonucleotide
cagatatctgaataacccaccag

SEQ ID NO: 1536 - DNA, 23 bp, Artificial Sequence
  Description of Artificial Sequence: Synthetic oligonucleotide
aagatacatggataatgttcagg

SEQ ID NO: 1537 - DNA, 23 bp, Artificial Sequence
  Description of Artificial Sequence: Synthetic oligonucleotide
aagaaacatgaagaaaactcagc

SEQ ID NO: 1538 - DNA, 23 bp, Artificial Sequence
  Description of Artificial Sequence: Synthetic oligonucleotide
aaaatacatggaaaatcctcatg

SEQ ID NO: 1539 - DNA, 23 bp, Artificial Sequence
  Description of Artificial Sequence: Synthetic oligonucleotide
attatacctgaataaacctgact

SEQ ID NO: 1540 - DNA, 23 bp, Artificial Sequence
  Description of Artificial Sequence: Synthetic oligonucleotide
gatttaccagaaaaaccctctgg

SEQ ID NO: 1541 - DNA, 23 bp, Artificial Sequence
  Description of Artificial Sequence: Synthetic oligonucleotide
gattgaccagaataaccctctgg

SEQ ID NO: 1542 - DNA, 24 bp, Artificial Sequence
  Description of Artificial Sequence: Synthetic oligonucleotide
aagatacatcgaataacccttcta

SEQ ID NO: 1543 - DNA, 23 bp, Artificial Sequence
  Description of Artificial Sequence: Synthetic oligonucleotide
aaggcaactgaagatccttcagg

SEQ ID NO: 1544 - DNA, 23 bp, Artificial Sequence
  Description of Artificial Sequence: Synthetic oligonucleotide
aagatatctgaattcagctcttg

SEQ ID NO: 1545 - DNA, 23 bp, Artificial Sequence
  Description of Artificial Sequence: Synthetic oligonucleotide
aagaaaacagaataaacctctca

SEQ ID NO: 1546 - DNA, 23 bp, Artificial Sequence
  Description of Artificial Sequence: Synthetic oligonucleotide
aagatagctgatgaaatatcagg

SEQ ID NO: 1547 - DNA, 22 bp, Artificial Sequence
  Description of Artificial Sequence: Synthetic oligonucleotide
atgatagtgaataagcctcagg

SEQ ID NO: 1548 - DNA, 23 bp, Artificial Sequence
  Description of Artificial Sequence: Synthetic oligonucleotide
aagattcatgtacaaacctcatg

SEQ ID NO: 1549 - DNA, 23 bp, Artificial Sequence
  Description of Artificial Sequence: Synthetic oligonucleotide
aagacacatgaagaaaactgagg

SEQ ID NO: 1550 - DNA, 21 bp, Artificial Sequence
  Description of Artificial Sequence: Synthetic oligonucleotide
aagttgactgaaaccctctgg

SEQ ID NO: 1551 - DNA, 24 bp, Artificial Sequence
  Description of Artificial Sequence: Synthetic oligonucleotide
gagataccctagataaccctcaga

SEQ ID NO: 1552 - DNA, 23 bp, Artificial Sequence
  Description of Artificial Sequence: Synthetic oligonucleotide
gtgataactgaataaccctgctc

SEQ ID NO: 1553 - DNA, 23 bp, Artificial Sequence
  Description of Artificial Sequence: Synthetic oligonucleotide
gagataactgcatagccctaggt

SEQ ID NO: 1554 - DNA, 22 bp, Artificial Sequence
  Description of Artificial Sequence: Synthetic oligonucleotide
gagacacctgaacgacctcagg

SEQ ID NO: 1555 - DNA, 23 bp, Artificial Sequence
  Description of Artificial Sequence: Synthetic oligonucleotide
aagacacctgactaaccccaggc

SEQ ID NO: 1556 - DNA, 23 bp, Artificial Sequence
  Description of Artificial Sequence: Synthetic oligonucleotide
tagacacctgaacaaccccaggc

SEQ ID NO: 1557 - DNA, 22 bp, Artificial Sequence
  Description of Artificial Sequence: Synthetic oligonucleotide
aagacacctggctgaccccagg

SEQ ID NO: 1558 - DNA, 22 bp, Artificial Sequence
  Description of Artificial Sequence: Synthetic oligonucleotide
aagacacctgagcaacctcagg

SEQ ID NO: 1559 - DNA, 23 bp, Artificial Sequence
  Description of Artificial Sequence: Synthetic oligonucleotide
aagatatctgagcaacactctgt

SEQ ID NO: 1560 - DNA, 23 bp, Artificial Sequence
  Description of Artificial Sequence: Synthetic oligonucleotide
gagatatgtgaataaaactctga

SEQ ID NO: 1561 - DNA, 22 bp, Artificial Sequence
  Description of Artificial Sequence: Synthetic oligonucleotide
cagaagctgaatgaccctttgg

SEQ ID NO: 1562 - DNA, 23 bp, Artificial Sequence
  Description of Artificial Sequence: Synthetic oligonucleotide
aaaataactgataaatcctctga

SEQ ID NO: 1563 - DNA, 22 bp, Artificial Sequence
  Description of Artificial Sequence: Synthetic oligonucleotide
aagctcctgcatagcccacagg

SEQ ID NO: 1564 - DNA, 22 bp, Artificial Sequence
  Description of Artificial Sequence: Synthetic oligonucleotide
aacatacctaaatataccctgg

SEQ ID NO: 1565 - DNA, 23 bp, Artificial Sequence
  Description of Artificial Sequence: Synthetic oligonucleotide
tagatacctgactttcccacttg

SEQ ID NO: 1566 - DNA, 23 bp, Artificial Sequence
  Description of Artificial Sequence: Synthetic oligonucleotide
aagattcctgaagcctcctcaga

SEQ ID NO: 1567 - DNA, 22 bp, Artificial Sequence
  Description of Artificial Sequence: Synthetic oligonucleotide
catatactgaataaccatctgg

SEQ ID NO: 1568 - DNA, 23 bp, Artificial Sequence
  Description of Artificial Sequence: Synthetic oligonucleotide
aagatatctgaaatgccctagag

SEQ ID NO: 1569 - DNA, 23 bp, Artificial Sequence
  Description of Artificial Sequence: Synthetic oligonucleotide
aaatagcctgaataaccctagtg

SEQ ID NO: 1570 - DNA, 23 bp, Artificial Sequence
  Description of Artificial Sequence: Synthetic oligonucleotide
aacaaacatgaataacactaagc

SEQ ID NO: 1571 - DNA, 23 bp, Artificial Sequence
  Description of Artificial Sequence: Synthetic oligonucleotide
aagaaatctgacaaacctttagg

SEQ ID NO: 1572 - DNA, 22 bp, Artificial Sequence
  Description of Artificial Sequence: Synthetic oligonucleotide
aagatccagaagaactctctga

SEQ ID NO: 1573 - DNA, 23 bp, Artificial Sequence
  Description of Artificial Sequence: Synthetic oligonucleotide
tagatacctaaatagcccatggg

SEQ ID NO: 1574 - DNA, 23 bp, Artificial Sequence
  Description of Artificial Sequence: Synthetic oligonucleotide
aagaaacctctataagcctctta

SEQ ID NO: 1575 - DNA, 22 bp, Artificial Sequence
  Description of Artificial Sequence: Synthetic oligonucleotide
aatctactgaataactctcagg

SEQ ID NO: 1576 - DNA, 23 bp, Artificial Sequence
  Description of Artificial Sequence: Synthetic oligonucleotide
atgaatactgaataacattcagg

SEQ ID NO: 1577 - DNA, 21 bp, Artificial Sequence
  Description of Artificial Sequence: Synthetic oligonucleotide
aagataccaataaccctcaaa

SEQ ID NO: 1578 - DNA, 23 bp, Artificial Sequence
  Description of Artificial Sequence: Synthetic oligonucleotide
aatgtacccgaacaaccctcagg

SEQ ID NO: 1579 - DNA, 24 bp, Artificial Sequence
  Description of Artificial Sequence: Synthetic oligonucleotide
cagatagctgaaagaacactcagg

SEQ ID NO: 1580 - DNA, 23 bp, Artificial Sequence
  Description of Artificial Sequence: Synthetic oligonucleotide
aacataactgaataaccataagg

SEQ ID NO: 1581 - DNA, 23 bp, Artificial Sequence
  Description of Artificial Sequence: Synthetic oligonucleotide
aatcaacctgaatatccatcagt

SEQ ID NO: 1582 - DNA, 22 bp, Artificial Sequence
  Description of Artificial Sequence: Synthetic oligonucleotide
aagatacccattcaccctctgg

SEQ ID NO: 1583 - DNA, 23 bp, Artificial Sequence
  Description of Artificial Sequence: Synthetic oligonucleotide
aaagaacctaaaaaaccctcttg

SEQ ID NO: 1584 - DNA, 22 bp, Artificial Sequence
  Description of Artificial Sequence: Synthetic oligonucleotide
aagataggggaaagccctctgg

SEQ ID NO: 1585 - DNA, 23 bp, Artificial Sequence
  Description of Artificial Sequence: Synthetic oligonucleotide
aaggcaaatgaataacccacagc

SEQ ID NO: 1586 - DNA, 21 bp, Artificial Sequence
  Description of Artificial Sequence: Synthetic oligonucleotide
aaaatacaaataaccctcagt

SEQ ID NO: 1587 - DNA, 22 bp, Artificial Sequence
  Description of Artificial Sequence: Synthetic oligonucleotide
aagatccagaagaattctctgg

SEQ ID NO: 1588 - DNA, 22 bp, Artificial Sequence
  Description of Artificial Sequence: Synthetic oligonucleotide
agaatacctgaatacccccaga

SEQ ID NO: 1589 - DNA, 23 bp, Artificial Sequence
  Description of Artificial Sequence: Synthetic oligonucleotide
caaataccttaatcaccatgagg

SEQ ID NO: 1590 - DNA, 23 bp, Artificial Sequence
  Description of Artificial Sequence: Synthetic oligonucleotide
aagatgccaacataaagctcagg

SEQ ID NO: 1591 - DNA, 21 bp, Artificial Sequence
  Description of Artificial Sequence: Synthetic oligonucleotide
taaatacctataaccctgagg

SEQ ID NO: 1592 - DNA, 23 bp, Artificial Sequence
  Description of Artificial Sequence: Synthetic oligonucleotide
agcacacatgaataaccctaagg

SEQ ID NO: 1593 - DNA, 22 bp, Artificial Sequence
  Description of Artificial Sequence: Synthetic oligonucleotide
aagatcccagaataactactgg

SEQ ID NO: 1594 - DNA, 19 bp, Artificial Sequence
  Description of Artificial Sequence: Synthetic oligonucleotide
ccaatggcctccttcagtt

SEQ ID NO: 1595 - DNA, 18 bp, Artificial Sequence
  Description of Artificial Sequence: Synthetic oligonucleotide
caatggcctccttcagtt

SEQ ID NO: 1596 - DNA, 17 bp, Artificial Sequence
  Description of Artificial Sequence: Synthetic oligonucleotide
aatggcctccttcagtt

SEQ ID NO: 1597 - DNA, 20 bp, Artificial Sequence
  Description of Artificial Sequence: Synthetic oligonucleotide
tccaatggcctccttcagtt

SEQ ID NO: 1598 - DNA, 20 bp, Artificial Sequence
  Description of Artificial Sequence: Synthetic oligonucleotide
gcgaatggcctcctgcagct

SEQ ID NO: 1599 - DNA, 20 bp, Artificial Sequence
  Description of Artificial Sequence: Synthetic oligonucleotide
agcccttcaacacaaggtca

SEQ ID NO: 1600 - DNA, 20 bp, Artificial Sequence
  Description of Artificial Sequence: Synthetic oligonucleotide
taagaccatgtcccaactga

SEQ ID NO: 1601 - DNA, 20 bp, Artificial Sequence
  Description of Artificial Sequence: Synthetic oligonucleotide
caatgtccccaatgcaatcc

SEQ ID NO: 1602 - DNA, 20 bp, Artificial Sequence
  Description of Artificial Sequence: Synthetic oligonucleotide
ttgttttccgggattgcatt

SEQ ID NO: 1603 - DNA, 20 bp, Artificial Sequence
  Description of Artificial Sequence: Synthetic oligonucleotide
tttgttttccgggattgcat

SEQ ID NO: 1604 - DNA, 20 bp, Artificial Sequence
  Description of Artificial Sequence: Synthetic oligonucleotide
aatcccggaaaacaaagatt

SEQ ID NO: 1605 - DNA, 20 bp, Artificial Sequence
  Description of Artificial Sequence: Synthetic oligonucleotide
tgttttccgggattgcattg

SEQ ID NO: 1606 - DNA, 18 bp, Artificial Sequence
  Description of Artificial Sequence: Synthetic oligonucleotide
gatacctgaataactctc

SEQ ID NO: 1607 - DNA, 17 bp, Artificial Sequence
  Description of Artificial Sequence: Synthetic oligonucleotide
atacctgaataactctc

SEQ ID NO: 1608 - DNA, 20 bp, Artificial Sequence
  Description of Artificial Sequence: Synthetic oligonucleotide
gcaaatcttgattttggctc

SEQ ID NO: 1609 - DNA, 20 bp, Artificial Sequence
  Description of Artificial Sequence: Synthetic oligonucleotide
gatgtaaaaattttagccaa

SEQ ID NO: 1610 - DNA, 20 bp, Artificial Sequence
  Description of Artificial Sequence: Synthetic oligonucleotide
atgaaaaacttgagagttgc

SEQ ID NO: 1611 - DNA, 20 bp, Artificial Sequence
  Description of Artificial Sequence: Synthetic oligonucleotide
acttgggatcacaaagcaaa

SEQ ID NO: 1612 - DNA, 20 bp, Artificial Sequence
  Description of Artificial Sequence: Synthetic oligonucleotide
aagatttggtgttttctact

SEQ ID NO: 1613 - DNA, 20 bp, Artificial Sequence
  Description of Artificial Sequence: Synthetic oligonucleotide
aaggagtacccggggctgca

SEQ ID NO: 1614 - DNA, 20 bp, Artificial Sequence
  Description of Artificial Sequence: Synthetic oligonucleotide
cagaggccaggagcgccagg

SEQ ID NO: 1615 - DNA, 20 bp, Artificial Sequence
  Description of Artificial Sequence: Synthetic oligonucleotide
agaggccaggagcgccagga

SEQ ID NO: 1616 - DNA, 20 bp, Artificial Sequence
  Description of Artificial Sequence: Synthetic oligonucleotide
ctcggcctctgaagctcctg

SEQ ID NO: 1617 - DNA, 19 bp, Artificial Sequence
  Description of Artificial Sequence: Synthetic oligonucleotide
cagctccaggcggtcctgg

SEQ ID NO: 1618 - RNA, 100 nt, Artificial Sequence; identical to SEQ ID NO: 253
  Description of Artificial Sequence: Synthetic polynucleotide

SEQ ID NO: 1619 - RNA, 100 nt, Artificial Sequence; identical to SEQ ID NO: 253
  Description of Artificial Sequence: Synthetic polynucleotide

SEQ ID NO: 1620 - RNA, 100 nt, Artificial Sequence; identical to SEQ ID NO: 253
  Description of Artificial Sequence: Synthetic polynucleotide

SEQ ID NO: 1621 - RNA, 100 nt, Artificial Sequence; identical to SEQ ID NO: 253
  Description of Artificial Sequence: Synthetic polynucleotide

SEQ ID NO: 1622 - RNA, 100 nt, Artificial Sequence
  Description of Artificial Sequence: Synthetic polynucleotide
  modified_base (1)..(1): Inosine
nccaauggccuccuucaguuguuuuagagcuagaaauagcaaguuaaaauaaggcuaguccguuaucaacuugaaaaaguggcaccgagucggugcuuuu

SEQ ID NO: 1623 - RNA, 99 nt, Artificial Sequence
  Description of Artificial Sequence: Synthetic oligonucleotide
ccaauggccuccuucaguuguuuuagagcuagaaauagcaaguuaaaauaaggcuaguccguuaucaacuugaaaaaguggcaccgagucggugcuuuu

SEQ ID NO: 1624 - RNA, 98 nt, Artificial Sequence
  Description of Artificial Sequence: Synthetic oligonucleotide
caauggccuccuucaguuguuuuagagcuagaaauagcaaguuaaaauaaggcuaguccguuaucaacuugaaaaaguggcaccgagucggugcuuuu

SEQ ID NO: 1625 - RNA, 98 nt, Artificial Sequence; identical to SEQ ID NO: 1624
  Description of Artificial Sequence: Synthetic oligonucleotide

SEQ ID NO: 1626 - RNA, 97 nt, Artificial Sequence
  Description of Artificial Sequence: Synthetic oligonucleotide
aauggccuccuucaguuguuuuagagcuagaaauagcaaguuaaaauaaggcuaguccguuaucaacuugaaaaaguggcaccgagucggugcuuuu

SEQ ID NO: 1627 - RNA, 97 nt, Artificial Sequence; identical to SEQ ID NO: 1626
  Description of Artificial Sequence: Synthetic oligonucleotide

SEQ ID NO: 1628 - RNA, 100 nt, Artificial Sequence
  Description of Artificial Sequence: Synthetic polynucleotide
  modified_base (18)..(18): Inosine
gccaauggccuccuucanuuguuuuagagcuagaaauagcaaguuaaaauaaggcuaguccguuaucaacuugaaaaaguggcaccgagucggugcuuuu

SEQ ID NO: 1629 - RNA, 100 nt, Artificial Sequence
  Description of Artificial Sequence: Synthetic polynucleotide
  modified_base (1)..(1): Inosine
  modified_base (18)..(18): Inosine
nccaauggccuccuucanuuguuuuagagcuagaaauagcaaguuaaaauaaggcuaguccguuaucaacuugaaaaaguggcaccgagucggugcuuuu

SEQ ID NO: 1630 - RNA, 100 nt, Artificial Sequence
  Description of Artificial Sequence: Synthetic polynucleotide
  modified_base (7)..(8): Inosine
  modified_base (18)..(18): Inosine
gccaaunnccuccuucanuuguuuuagagcuagaaauagcaaguuaaaauaaggcuaguccguuaucaacuugaaaaaguggcaccgagucggugcuuuu

SEQ ID NO: 1631 - RNA, 100 nt, Artificial Sequence
  Description of Artificial Sequence: Synthetic polynucleotide
accaauggccuccuucaguuguuuuagagcuagaaauagcaaguuaaaauaaggcuaguccguuaucaacuugaaaaaguggcaccgagucggugcuuuu

SEQ ID NO: 1632 - RNA, 100 nt, Artificial Sequence
  Description of Artificial Sequence: Synthetic polynucleotide
  modified_base (1)..(1): Inosine
  modified_base (7)..(7): Inosine
nccaaungccuccuucaguuguuuuagagcuagaaauagcaaguuaaaauaaggcuaguccguuaucaacuugaaaaaguggcaccgagucggugcuuuu

SEQ ID NO: 1633 - RNA, 100 nt, Artificial Sequence
  Description of Artificial Sequence: Synthetic polynucleotide
  modified_base (7)..(7): Inosine
gccaaungccuccuucaguuguuuuagagcuagaaauagcaaguuaaaauaaggcuaguccguuaucaacuugaaaaaguggcaccgagucggugcuuuu

SEQ ID NO: 1634 - RNA, 100 nt, Artificial Sequence
  Description of Artificial Sequence: Synthetic polynucleotide
gcgaauggccuccugcagcuguuuuagagcuagaaauagcaaguuaaaauaaggcuaguccguuaucaacuugaaaaaguggcaccgagucggugcuuuu

SEQ ID NO: 1635 - RNA, 100 nt, Artificial Sequence
  Description of Artificial Sequence: Synthetic polynucleotide
agcccuucaacacaaggucaguuuuagagcuagaaauagcaaguuaaaauaaggcuaguccguuaucaacuugaaaaaguggcaccgagucggugcuuuu

SEQ ID NO: 1636 - RNA, 100 nt, Artificial Sequence
  Description of Artificial Sequence: Synthetic polynucleotide
uaagaccaugucccaacugaguuuuagagcuagaaauagcaaguuaaaauaaggcuaguccguuaucaacuugaaaaaguggcaccgagucggugcuuuu

SEQ ID NO: 1637 - RNA, 100 nt, Artificial Sequence
  Description of Artificial Sequence: Synthetic polynucleotide
caauguccccaaugcaauccguuuuagagcuagaaauagcaaguuaaaauaaggcuaguccguuaucaacuugaaaaaguggcaccgagucggugcuuuu

SEQ ID NO: 1638 - RNA, 100 nt, Artificial Sequence
  Description of Artificial Sequence: Synthetic polynucleotide
uuguuuuccgggauugcauuguuuuagagcuagaaauagcaaguuaaaauaaggcuaguccguuaucaacuugaaaaaguggcaccgagucggugcuuuu

SEQ ID NO: 1639 - RNA, 100 nt, Artificial Sequence
  Description of Artificial Sequence: Synthetic polynucleotide
uuuguuuuccgggauugcauguuuuagagcuagaaauagcaaguuaaaauaaggcuaguccguuaucaacuugaaaaaguggcaccgagucggugcuuuu

SEQ ID NO: 1640 - RNA, 100 nt, Artificial Sequence
  Description of Artificial Sequence: Synthetic polynucleotide
aaucccggaaaacaaagauuguuuuagagcuagaaauagcaaguuaaaauaaggcuaguccguuaucaacuugaaaaaguggcaccgagucggugcuuuu

SEQ ID NO: 1641 - RNA, 100 nt, Artificial Sequence
  Description of Artificial Sequence: Synthetic polynucleotide
uguuuuccgggauugcauugguuuuagagcuagaaauagcaaguuaaaauaaggcuaguccguuaucaacuugaaaaaguggcaccgagucggugcuuuu

SEQ ID NO: 1642 - RNA, 100 nt, Artificial Sequence; identical to SEQ ID NO: 421
  Description of Artificial Sequence: Synthetic polynucleotide

SEQ ID NO: 1643 - RNA, 103 nt, Artificial Sequence
  Description of Artificial Sequence: Synthetic polynucleotide
cccauaccuuggagcaacggguuuuagagcuagaaauagcaaguuaaaauaaggcuaguccguuaucaacuugaaaaaguggcaccgagucggugcuuuuuuu

SEQ ID NO: 1644 - RNA, 103 nt, Artificial Sequence; identical to SEQ ID NO: 1643
  Description of Artificial Sequence: Synthetic polynucleotide

SEQ ID NO: 1645 - RNA, 103 nt, Artificial Sequence; identical to SEQ ID NO: 1643
  Description of Artificial Sequence: Synthetic polynucleotide

SEQ ID NO: 1646 - RNA, 103 nt, Artificial Sequence; identical to SEQ ID NO: 1643
  Description of Artificial Sequence: Synthetic polynucleotide

SEQ ID NO: 1647 - RNA, 103 nt, Artificial Sequence; identical to SEQ ID NO: 1643
  Description of Artificial Sequence: Synthetic polynucleotide

SEQ ID NO: 1648 - DNA, 100 bp, Artificial Sequence; identical to SEQ ID NO: 429
  Description of Artificial Sequence: Synthetic oligonucleotide
  Description of Combined DNA/RNA Molecule: Synthetic oligonucleotide

SEQ ID NO: 1649 - DNA, 108 bp, Artificial Sequence
  Description of Artificial Sequence: Synthetic oligonucleotide
  Description of Combined DNA/RNA Molecule: Synthetic oligonucleotide
cccgcaccuuggcgcagcggguuuuagaguuuuagagcuagaaauagcaaguuaaaauaaggcuaguccguuaucaacuugaaaaaguggcaccgagucggugcuuuu

SEQ ID NO: 1650 - RNA, 99 nt, Artificial Sequence; identical to SEQ ID NO: 442
  Description of Artificial Sequence: Synthetic oligonucleotide

SEQ ID NO: 1651 - RNA, 98 nt, Artificial Sequence; identical to SEQ ID NO: 443
  Description of Artificial Sequence: Synthetic oligonucleotide

SEQ ID NO: 1652 - RNA, 98 nt, Artificial Sequence
  Description of Artificial Sequence: Synthetic oligonucleotide
gauaccugaauaacucucguuuuagagcuagaaauagcaaguuaaaauaaggcuaguccguuaucaacuugaaaaaguggcaccgagucggugcuuuu

SEQ ID NO: 1653 - RNA, 97 nt, Artificial Sequence
  Description of Artificial Sequence: Synthetic oligonucleotide
auaccugaauaacucucguuuuagagcuagaaauagcaaguuaaaauaaggcuaguccguuaucaacuugaaaaaguggcaccgagucggugcuuuu

SEQ ID NO: 1654 - RNA, 100 nt, Artificial Sequence
  Description of Artificial Sequence: Synthetic polynucleotide
  modified_base (6)..(6): Nebularine
aagaunccugaauaacccucguuuuagagcuagaaauagcaaguuaaaauaaggcuaguccguuaucaacuugaaaaaguggcaccgagucggugcuuuu

SEQ ID NO: 1655 - RNA, 100 nt, Artificial Sequence
  Description of Artificial Sequence: Synthetic polynucleotide
  modified_base (6)..(6): Nebularine
  modified_base (11)..(11): Nebularine
aagaunccugnauaacccucguuuuagagcuagaaauagcaaguuaaaauaaggcuaguccguuaucaacuugaaaaaguggcaccgagucggugcuuuu

SEQ ID NO: 1656 - RNA, 100 nt, Artificial Sequence
  Description of Artificial Sequence: Synthetic polynucleotide
  modified_base (6)..(6): Nebularine
  modified_base (15)..(15): Nebularine
aagaunccugaauancccucguuuuagagcuagaaauagcaaguuaaaauaaggcuaguccguuaucaacuugaaaaaguggcaccgagucggugcuuuu

SEQ ID NO: 1657 - RNA, 100 nt, Artificial Sequence
  Description of Artificial Sequence: Synthetic polynucleotide
  modified_base (6)..(6): Nebularine
  modified_base (11)..(11): Nebularine
  modified_base (14)..(14): Nebularine
aagaunccugnaunacccucguuuuagagcuagaaauagcaaguuaaaauaaggcuaguccguuaucaacuugaaaaaguggcaccgagucggugcuuuu

SEQ ID NO: 1658 - RNA, 100 nt, Artificial Sequence
  Description of Artificial Sequence: Synthetic polynucleotide
  modified_base (4)..(4): Nebularine
  modified_base (6)..(6): Nebularine
aagnunccugaauaacccucguuuuagagcuagaaauagcaaguuaaaauaaggcuaguccguuaucaacuugaaaaaguggcaccgagucggugcuuuu

SEQ ID NO: 1659 - RNA, 100 nt, Artificial Sequence
  Description of Artificial Sequence: Synthetic polynucleotide
  modified_base (4)..(4): Nebularine
  modified_base (6)..(6): Nebularine
  modified_base (15)..(15): Nebularine
aagnunccugaauancccucguuuuagagcuagaaauagcaaguuaaaauaaggcuaguccguuaucaacuugaaaaaguggcaccgagucggugcuuuu

SEQ ID NO: 1660 - RNA, 100 nt, Artificial Sequence
  Description of Artificial Sequence: Synthetic polynucleotide
  modified_base (4)..(4): Nebularine
  modified_base (14)..(14): Nebularine
aagnuaccugaaunacccucguuuuagagcuagaaauagcaaguuaaaauaaggcuaguccguuaucaacuugaaaaaguggcaccgagucggugcuuuu

SEQ ID NO: 1661 - RNA, 100 nt, Artificial Sequence
  Description of Artificial Sequence: Synthetic polynucleotide
  modified_base (11)..(11): Nebularine
aagauaccugnauaacccucguuuuagagcuagaaauagcaaguuaaaauaaggcuaguccguuaucaacuugaaaaaguggcaccgagucggugcuuuu

SEQ ID NO: 1662 - RNA, 100 nt, Artificial Sequence
  Description of Artificial Sequence: Synthetic polynucleotide
  modified_base (11)..(11): Nebularine
  modified_base (15)..(15): Nebularine
aagauaccugnauancccucguuuuagagcuagaaauagcaaguuaaaauaaggcuaguccguuaucaacuugaaaaaguggcaccgagucggugcuuuu

SEQ ID NO: 1663 - RNA, 100 nt, Artificial Sequence; identical to SEQ ID NO: 55
  Description of Artificial Sequence: Synthetic polynucleotide

SEQ ID NO: 1664 - RNA, 100 nt, Artificial Sequence; identical to SEQ ID NO: 55
  Description of Artificial Sequence: Synthetic polynucleotide

SEQ ID NO: 1665 - RNA, 100 nt, Artificial Sequence; identical to SEQ ID NO: 421
  Description of Artificial Sequence: Synthetic polynucleotide

SEQ ID NO: 1666 - RNA, 100 nt, Artificial Sequence; identical to SEQ ID NO: 422
  Description of Artificial Sequence: Synthetic polynucleotide

SEQ ID NO: 1667 - RNA, 100 nt, Artificial Sequence; identical to SEQ ID NO: 55
  Description of Artificial Sequence: Synthetic polynucleotide

SEQ ID NO: 1668 - RNA, 100 nt, Artificial Sequence; identical to SEQ ID NO: 55
  Description of Artificial Sequence: Synthetic polynucleotide

SEQ ID NO: 1669 - RNA, 100 nt, Artificial Sequence; identical to SEQ ID NO: 421
  Description of Artificial Sequence: Synthetic polynucleotide

SEQ ID NO: 1670 - RNA, 100 nt, Artificial Sequence; identical to SEQ ID NO: 422
  Description of Artificial Sequence: Synthetic polynucleotide

SEQ ID NO: 1671 - RNA, 100 nt, Artificial Sequence; identical to SEQ ID NO: 55
  Description of Artificial Sequence: Synthetic polynucleotide

SEQ ID NO: 1672 - RNA, 100 nt, Artificial Sequence; identical to SEQ ID NO: 55
  Description of Artificial Sequence: Synthetic polynucleotide

SEQ ID NO: 1673 - RNA, 100 nt, Artificial Sequence; identical to SEQ ID NO: 421
  Description of Artificial Sequence: Synthetic polynucleotide

SEQ ID NO: 1674 - RNA, 100 nt, Artificial Sequence; identical to SEQ ID NO: 422
  Description of Artificial Sequence: Synthetic polynucleotide

SEQ ID NO: 1675 - RNA, 100 nt, Artificial Sequence; identical to SEQ ID NO: 55
  Description of Artificial Sequence: Synthetic polynucleotide

SEQ ID NO: 1676 - RNA, 100 nt, Artificial Sequence; identical to SEQ ID NO: 421
  Description of Artificial Sequence: Synthetic polynucleotide

SEQ ID NO: 1677 - RNA, 100 nt, Artificial Sequence; identical to SEQ ID NO: 422
  Description of Artificial Sequence: Synthetic polynucleotide

SEQ ID NO: 1678 - RNA, 100 nt, Artificial Sequence; identical to SEQ ID NO: 55
  Description of Artificial Sequence: Synthetic polynucleotide

SEQ ID NO: 1679 - RNA, 100 nt, Artificial Sequence; identical to SEQ ID NO: 55
  Description of Artificial Sequence: Synthetic polynucleotide

SEQ ID NO: 1680 - RNA, 100 nt, Artificial Sequence; identical to SEQ ID NO: 55
  Description of Artificial Sequence: Synthetic polynucleotide

SEQ ID NO: 1681 - RNA, 100 nt, Artificial Sequence; identical to SEQ ID NO: 421
  Description of Artificial Sequence: Synthetic polynucleotide

SEQ ID NO: 1682 - RNA, 100 nt, Artificial Sequence; identical to SEQ ID NO: 421
  Description of Artificial Sequence: Synthetic polynucleotide

SEQ ID NO: 1683 - RNA, 100 nt, Artificial Sequence; identical to SEQ ID NO: 422
  Description of Artificial Sequence: Synthetic polynucleotide

SEQ ID NO: 1684 - RNA, 100 nt, Artificial Sequence; identical to SEQ ID NO: 55
  Description of Artificial Sequence: Synthetic polynucleotide

SEQ ID NO: 1685 - RNA, 100 nt, Artificial Sequence; identical to SEQ ID NO: 421
  Description of Artificial Sequence: Synthetic polynucleotide

SEQ ID NO: 1686 - RNA, 100 nt, Artificial Sequence; identical to SEQ ID NO: 422
  Description of Artificial Sequence: Synthetic polynucleotide

SEQ ID NO: 1687 - RNA, 100 nt, Artificial Sequence; identical to SEQ ID NO: 55
  Description of Artificial Sequence: Synthetic polynucleotide

SEQ ID NO: 1688 - RNA, 100 nt, Artificial Sequence; identical to SEQ ID NO: 55
  Description of Artificial Sequence: Synthetic polynucleotide

SEQ ID NO: 1689 - RNA, 100 nt, Artificial Sequence; identical to SEQ ID NO: 421
  Description of Artificial Sequence: Synthetic polynucleotide

SEQ ID NO: 1690 - RNA, 100 nt, Artificial Sequence; identical to SEQ ID NO: 422
  Description of Artificial Sequence: Synthetic polynucleotide

SEQ ID NO: 1691 - RNA, 100 nt, Artificial Sequence; identical to SEQ ID NO: 55
  Description of Artificial Sequence: Synthetic polynucleotide

SEQ ID NO: 1692 - RNA, 100 nt, Artificial Sequence; identical to SEQ ID NO: 55
  Description of Artificial Sequence: Synthetic polynucleotide

SEQ ID NO: 1693 - RNA, 100 nt, Artificial Sequence; identical to SEQ ID NO: 421
  Description of Artificial Sequence: Synthetic polynucleotide

SEQ ID NO: 1694 - RNA, 100 nt, Artificial Sequence; identical to SEQ ID NO: 422
  Description of Artificial Sequence: Synthetic polynucleotide

SEQ ID NO: 1695 - RNA, 100 nt, Artificial Sequence; identical to SEQ ID NO: 55
  Description of Artificial Sequence: Synthetic polynucleotide

SEQ ID NO: 1696 - RNA, 100 nt, Artificial Sequence; identical to SEQ ID NO: 421
  Description of Artificial Sequence: Synthetic polynucleotide

SEQ ID NO: 1697 - RNA, 100 nt, Artificial Sequence; identical to SEQ ID NO: 422
  Description of Artificial Sequence: Synthetic polynucleotide

SEQ ID NO: 1698 - RNA, 100 nt, Artificial Sequence; identical to SEQ ID NO: 55
  Description of Artificial Sequence: Synthetic polynucleotide

SEQ ID NO: 1699 - RNA, 103 nt, Artificial Sequence
  Description of Artificial Sequence: Synthetic polynucleotide
gagauaccugaguaacuuucguuuuagagcuagaaauagcaaguuaaaauaaggcuaguccguuaucaacuugaaaaaguggcaccgagucggugcuuuuuuu

SEQ ID NO: 1700 - RNA, 103 nt, Artificial Sequence
  Description of Artificial Sequence: Synthetic polynucleotide
cagguuccaugggaugcucuguuuuagagcuagaaauagcaaguuaaaauaaggcuaguccguuaucaacuugaaaaaguggcaccgagucggugcuuuuuuu

SEQ ID NO: 1701 - RNA, 103 nt, Artificial Sequence; identical to SEQ ID NO: 1643
  Description of Artificial Sequence: Synthetic polynucleotide

SEQ ID NO: 1702 - RNA, 103 nt, Artificial Sequence; identical to SEQ ID NO: 1699
  Description of Artificial Sequence: Synthetic polynucleotide

SEQ ID NO: 1703 - RNA, 103 nt, Artificial Sequence; identical to SEQ ID NO: 1700
  Description of Artificial Sequence: Synthetic polynucleotide

SEQ ID NO: 1704 - RNA, 103 nt, Artificial Sequence; identical to SEQ ID NO: 1643
  Description of Artificial Sequence: Synthetic polynucleotide

SEQ ID NO: 1705 - RNA, 103 nt, Artificial Sequence; identical to SEQ ID NO: 1699
  Description of Artificial Sequence: Synthetic polynucleotide

SEQ ID NO: 1706 - RNA, 103 nt, Artificial Sequence; identical to SEQ ID NO: 1700
  Description of Artificial Sequence: Synthetic polynucleotide

SEQ ID NO: 1707 - RNA, 103 nt, Artificial Sequence; identical to SEQ ID NO: 1643
  Description of Artificial Sequence: Synthetic polynucleotide

SEQ ID NO: 1708 - RNA, 103 nt, Artificial Sequence; identical to SEQ ID NO: 1699
  Description of Artificial Sequence: Synthetic polynucleotide

SEQ ID NO: 1709 - RNA, 103 nt, Artificial Sequence; identical to SEQ ID NO: 1700
  Description of Artificial Sequence: Synthetic polynucleotide

SEQ ID NO: 1710 - RNA, 103 nt, Artificial Sequence; identical to SEQ ID NO: 1643
  Description of Artificial Sequence: Synthetic polynucleotide

SEQ ID NO: 1711 - RNA, 103 nt, Artificial Sequence; identical to SEQ ID NO: 1699
  Description of Artificial Sequence: Synthetic polynucleotide

SEQ ID NO: 1712 - RNA, 103 nt, Artificial Sequence; identical to SEQ ID NO: 1700
  Description of Artificial Sequence: Synthetic polynucleotide

SEQ ID NO: 1713 - RNA, 103 nt, Artificial Sequence; identical to SEQ ID NO: 1643
  Description of Artificial Sequence: Synthetic polynucleotide

SEQ ID NO: 1714 - RNA, 103 nt, Artificial Sequence; identical to SEQ ID NO: 1699
  Description of Artificial Sequence: Synthetic polynucleotide

SEQ ID NO: 1715 - RNA, 103 nt, Artificial Sequence; identical to SEQ ID NO: 1700
  Description of Artificial Sequence: Synthetic polynucleotide

SEQ ID NO: 1716 - RNA, 103 nt, Artificial Sequence; identical to SEQ ID NO: 1643
  Description of Artificial Sequence: Synthetic polynucleotide

SEQ ID NO: 1717 - RNA, 103 nt, Artificial Sequence; identical to SEQ ID NO: 1699
  Description of Artificial Sequence: Synthetic polynucleotide

SEQ ID NO: 1718 - RNA, 103 nt, Artificial Sequence; identical to SEQ ID NO: 1700
  Description of Artificial Sequence: Synthetic polynucleotide

SEQ ID NO: 1719 - RNA, 103 nt, Artificial Sequence; identical to SEQ ID NO: 1643
  Description of Artificial Sequence: Synthetic polynucleotide

SEQ ID NO: 1720 - RNA, 103 nt, Artificial Sequence; identical to SEQ ID NO: 1699
  Description of Artificial Sequence: Synthetic polynucleotide

SEQ ID NO: 1721 - RNA, 103 nt, Artificial Sequence; identical to SEQ ID NO: 1700
  Description of Artificial Sequence: Synthetic polynucleotide

SEQ ID NO: 1722 - RNA, 103 nt, Artificial Sequence; identical to SEQ ID NO: 1700
  Description of Artificial Sequence: Synthetic polynucleotide

SEQ ID NO: 1723 - RNA, 103 nt, Artificial Sequence; identical to SEQ ID NO: 1643
  Description of Artificial Sequence: Synthetic polynucleotide

SEQ ID NO: 1724 - RNA, 103 nt, Artificial Sequence; identical to SEQ ID NO: 1699
  Description of Artificial Sequence: Synthetic polynucleotide

SEQ ID NO: 1725 - RNA, 103 nt, Artificial Sequence; identical to SEQ ID NO: 1700
  Description of Artificial Sequence: Synthetic polynucleotide

SEQ ID NO: 1726 - RNA, 103 nt, Artificial Sequence; identical to SEQ ID NO: 1643
  Description of Artificial Sequence: Synthetic polynucleotide

SEQ ID NO: 1727 - RNA, 103 nt, Artificial Sequence; identical to SEQ ID NO: 1699
  Description of Artificial Sequence: Synthetic polynucleotide

SEQ ID NO: 1728 - RNA, 103 nt, Artificial Sequence; identical to SEQ ID NO: 1700
  Description of Artificial Sequence: Synthetic polynucleotide

SEQ ID NO: 1729 - RNA, 103 nt, Artificial Sequence; identical to SEQ ID NO: 1643
  Description of Artificial Sequence: Synthetic polynucleotide

SEQ ID NO: 1730 - RNA, 103 nt, Artificial Sequence; identical to SEQ ID NO: 1699
  Description of Artificial Sequence: Synthetic polynucleotide

SEQ ID NO: 1731 - RNA, 103 nt, Artificial Sequence; identical to SEQ ID NO: 1700
  Description of Artificial Sequence: Synthetic polynucleotide

SEQ ID NO: 1732 - RNA, 103 nt, Artificial Sequence; identical to SEQ ID NO: 1643
  Description of Artificial Sequence: Synthetic polynucleotide

SEQ ID NO: 1733 - RNA, 103 nt, Artificial Sequence; identical to SEQ ID NO: 1699
  Description of Artificial Sequence: Synthetic polynucleotide

SEQ ID NO: 1734 - RNA, 103 nt, Artificial Sequence; identical to SEQ ID NO: 1700
  Description of Artificial Sequence: Synthetic polynucleotide

SEQ ID NO: 1735 - RNA, 103 nt, Artificial Sequence; identical to SEQ ID NO: 1643
  Description of Artificial Sequence: Synthetic polynucleotide

SEQ ID NO: 1736 - RNA, 103 nt, Artificial Sequence; identical to SEQ ID NO: 1699
  Description of Artificial Sequence: Synthetic polynucleotide

SEQ ID NO: 1737 - RNA, 103 nt, Artificial Sequence; identical to SEQ ID NO: 1700
  Description of Artificial Sequence: Synthetic polynucleotide

SEQ ID NO: 1738 - RNA, 103 nt, Artificial Sequence; identical to SEQ ID NO: 1643
  Description of Artificial Sequence: Synthetic polynucleotide

SEQ ID NO: 1739 - RNA, 103 nt, Artificial Sequence; identical to SEQ ID NO: 1699
  Description of Artificial Sequence: Synthetic polynucleotide

SEQ ID NO: 1740 - RNA, 103 nt, Artificial Sequence; identical to SEQ ID NO: 1700
  Description of Artificial Sequence: Synthetic polynucleotide

SEQ ID NO: 1741 - RNA, 103 nt, Artificial Sequence; identical to SEQ ID NO: 1643
  Description of Artificial Sequence: Synthetic polynucleotide

SEQ ID NO: 1742 - RNA, 103 nt, Artificial Sequence; identical to SEQ ID NO: 1699
  Description of Artificial Sequence: Synthetic polynucleotide

SEQ ID NO: 1743 - RNA, 103 nt, Artificial Sequence; identical to SEQ ID NO: 1700
  Description of Artificial Sequence: Synthetic polynucleotide

SEQ ID NO: 1744 - RNA, 103 nt, Artificial Sequence; identical to SEQ ID NO: 1643
  Description of Artificial Sequence: Synthetic polynucleotide

SEQ ID NO: 1745 - RNA, 103 nt, Artificial Sequence; identical to SEQ ID NO: 1699
  Description of Artificial Sequence: Synthetic polynucleotide

SEQ ID NO: 1746 - RNA, 102 nt, Artificial Sequence
  Description of Artificial Sequence: Synthetic polynucleotide
gaauaccugaguaacuuucguuuuagagcuagaaauagcaaguuaaaauaaggcuaguccguuaucaacuugaaaaaguggcaccgagucggugcuuuuuuu

SEQ ID NO: 1747 - RNA, 103 nt, Artificial Sequence; identical to SEQ ID NO: 1700
  Description of Artificial Sequence: Synthetic polynucleotide

SEQ ID NO: 1748 - RNA, 103 nt, Artificial Sequence; identical to SEQ ID NO: 1700
  Description of Artificial Sequence: Synthetic polynucleotide

SEQ ID NO: 1749 - RNA, 103 nt, Artificial Sequence; identical to SEQ ID NO: 1700
  Description of Artificial Sequence: Synthetic polynucleotide

SEQ ID NO: 1750 - RNA, 103 nt, Artificial Sequence; identical to SEQ ID NO: 1699
  Description of Artificial Sequence: Synthetic polynucleotide

SEQ ID NO: 1751 - RNA, 103 nt, Artificial Sequence; identical to SEQ ID NO: 1699
  Description of Artificial Sequence: Synthetic polynucleotide

SEQ ID NO: 1752 - RNA, 103 nt, Artificial Sequence; identical to SEQ ID NO: 1700
  Description of Artificial Sequence: Synthetic polynucleotide

SEQ ID NO: 1753 - RNA, 103 nt, Artificial Sequence; identical to SEQ ID NO: 1699
  Description of Artificial Sequence: Synthetic polynucleotide

SEQ ID NO: 1754 - RNA, 103 nt, Artificial Sequence; identical to SEQ ID NO: 1700
  Description of Artificial Sequence: Synthetic polynucleotide

SEQ ID NO: 1755 - RNA, 103 nt, Artificial Sequence; identical to SEQ ID NO: 1643
  Description of Artificial Sequence: Synthetic polynucleotide

SEQ ID NO: 1756 - RNA, 103 nt, Artificial Sequence; identical to SEQ ID NO: 1699
  Description of Artificial Sequence: Synthetic polynucleotide

SEQ ID NO: 1757 - RNA, 103 nt, Artificial Sequence; identical to SEQ ID NO: 1700
  Description of Artificial Sequence: Synthetic polynucleotide

SEQ ID NO: 1758 - RNA, 103 nt, Artificial Sequence; identical to SEQ ID NO: 1699
  Description of Artificial Sequence: Synthetic polynucleotide

SEQ ID NO: 1759 - RNA, 103 nt, Artificial Sequence; identical to SEQ ID NO: 1700
  Description of Artificial Sequence: Synthetic polynucleotide

SEQ ID NO: 1760 - RNA, 103 nt, Artificial Sequence; identical to SEQ ID NO: 1700
  Description of Artificial Sequence: Synthetic polynucleotide

SEQ ID NO: 1761 - RNA, 103 nt, Artificial Sequence; identical to SEQ ID NO: 1643
  Description of Artificial Sequence: Synthetic polynucleotide

SEQ ID NO: 1762 - RNA, 103 nt, Artificial Sequence; identical to SEQ ID NO: 1699
  Description of Artificial Sequence: Synthetic polynucleotide

SEQ ID NO: 1763 - RNA, 103 nt, Artificial Sequence; identical to SEQ ID NO: 1700
  Description of Artificial Sequence: Synthetic polynucleotide

SEQ ID NO: 1764 - RNA, 103 nt, Artificial Sequence; identical to SEQ ID NO: 1643
  Description of Artificial Sequence: Synthetic polynucleotide

SEQ ID NO: 1765 - RNA, 103 nt, Artificial Sequence; identical to SEQ ID NO: 1699
  Description of Artificial Sequence: Synthetic polynucleotide

SEQ ID NO: 1766 - RNA, 103 nt, Artificial Sequence; identical to SEQ ID NO: 1700
  Description of Artificial Sequence: Synthetic polynucleotide

SEQ ID NO: 1767 - RNA, 103 nt, Artificial Sequence; identical to SEQ ID NO: 1643
  Description of Artificial Sequence: Synthetic polynucleotide

SEQ ID NO: 1768 - RNA, 103 nt, Artificial Sequence; identical to SEQ ID NO: 1699
  Description of Artificial Sequence: Synthetic polynucleotide

SEQ ID NO: 1769 - RNA, 103 nt, Artificial Sequence; identical to SEQ ID NO: 1700
  Description of Artificial Sequence: Synthetic polynucleotide

SEQ ID NO: 1770 - RNA, 103 nt, Artificial Sequence; identical to SEQ ID NO: 1700
  Description of Artificial Sequence: Synthetic polynucleotide

SEQ ID NO: 1771 - RNA, 103 nt, Artificial Sequence; identical to SEQ ID NO: 1700
  Description of Artificial Sequence: Synthetic polynucleotide

SEQ ID NO: 1772 - RNA, 103 nt, Artificial Sequence; identical to SEQ ID NO: 1643
  Description of Artificial Sequence: Synthetic polynucleotide

SEQ ID NO: 1773 - RNA, 103 nt, Artificial Sequence; identical to SEQ ID NO: 1699
  Description of Artificial Sequence: Synthetic polynucleotide

SEQ ID NO: 1774 - RNA, 103 nt, Artificial Sequence; identical to SEQ ID NO: 1643
  Description of Artificial Sequence: Synthetic polynucleotide

SEQ ID NO: 1775 - RNA, 103 nt, Artificial Sequence; identical to SEQ ID NO: 1699
  Description of Artificial Sequence: Synthetic polynucleotide

SEQ ID NO: 1776 - RNA, 103 nt, Artificial Sequence; identical to SEQ ID NO: 1700
  Description of Artificial Sequence: Synthetic polynucleotide

SEQ ID NO: 1777 - RNA, 103 nt, Artificial Sequence; identical to SEQ ID NO: 1643
  Description of Artificial Sequence: Synthetic polynucleotide

SEQ ID NO: 1778 - RNA, 103 nt, Artificial Sequence; identical to SEQ ID NO: 1699
  Description of Artificial Sequence: Synthetic polynucleotide

SEQ ID NO: 1779 - RNA, 103 nt, Artificial Sequence; identical to SEQ ID NO: 1700
  Description of Artificial Sequence: Synthetic polynucleotide

SEQ ID NO: 1780 - RNA, 103 nt, Artificial Sequence; identical to SEQ ID NO: 1643
  Description of Artificial Sequence: Synthetic polynucleotide

SEQ ID NO: 1781 - RNA, 103 nt, Artificial Sequence; identical to SEQ ID NO: 1699
  Description of Artificial Sequence: Synthetic polynucleotide

SEQ ID NO: 1782 - RNA, 103 nt, Artificial Sequence; identical to SEQ ID NO: 1700
  Description of Artificial Sequence: Synthetic polynucleotide

SEQ ID NO: 1783 - RNA, 103 nt, Artificial Sequence; identical to SEQ ID NO: 1643
  Description of Artificial Sequence: Synthetic polynucleotide

SEQ ID NO: 1784 - RNA, 103 nt, Artificial Sequence; identical to SEQ ID NO: 1699
  Description of Artificial Sequence: Synthetic polynucleotide

SEQ ID NO: 1785 - RNA, 103 nt, Artificial Sequence; identical to SEQ ID NO: 1700
  Description of Artificial Sequence: Synthetic polynucleotide

SEQ ID NO: 1786 - RNA, 103 nt, Artificial Sequence; identical to SEQ ID NO: 1643
  Description of Artificial Sequence: Synthetic polynucleotide

SEQ ID NO: 1787 - RNA, 103 nt, Artificial Sequence; identical to SEQ ID NO: 1699
  Description of Artificial Sequence: Synthetic polynucleotide

SEQ ID NO: 1788 - RNA, 103 nt, Artificial Sequence; identical to SEQ ID NO: 1700
  Description of Artificial Sequence: Synthetic polynucleotide

SEQ ID NO: 1789 - RNA, 103 nt, Artificial Sequence; identical to SEQ ID NO: 1643
  Description of Artificial Sequence: Synthetic polynucleotide

SEQ ID NO: 1790 - RNA, 103 nt, Artificial Sequence; identical to SEQ ID NO: 1699
  Description of Artificial Sequence: Synthetic polynucleotide

SEQ ID NO: 1791 - RNA, 103 nt, Artificial Sequence; identical to SEQ ID NO: 1700
  Description of Artificial Sequence: Synthetic polynucleotide

SEQ ID NO: 1792 - RNA, 103 nt, Artificial Sequence; identical to SEQ ID NO: 1643
  Description of Artificial Sequence: Synthetic polynucleotide

SEQ ID NO: 1793 - RNA, 103 nt, Artificial Sequence; identical to SEQ ID NO: 1699
  Description of Artificial Sequence: Synthetic polynucleotide

SEQ ID NO: 1794 - RNA, 103 nt, Artificial Sequence; identical to SEQ ID NO: 1700
  Description of Artificial Sequence: Synthetic polynucleotide

SEQ ID NO: 1795 - RNA, 103 nt, Artificial Sequence
  Description of Artificial Sequence: Synthetic polynucleotide
  modified_base (101)..(103): a, c, u, g, unknown or other
cccauaccuuggagcaacggguuuuagagcuagaaauagcaaguuaaaauaaggcuaguccguuaucaacuugaaaaaguggcaccgagucggugcuuuunnn

SEQ ID NO: 1796 - RNA, 103 nt, Artificial Sequence
  Description of Artificial Sequence: Synthetic polynucleotide
  modified_base (101)..(103): a, c, u, g, unknown or other
gagauaccugaguaacuuucguuuuagagcuagaaauagcaaguuaaaauaaggcuaguccguuaucaacuugaaaaaguggcaccgagucggugcuuuunnn

SEQ ID NO: 1797 - RNA, 103 nt, Artificial Sequence
  Description of Artificial Sequence: Synthetic polynucleotide
  modified_base (101)..(103): a, c, u, g, unknown or other
cagguuccaugggaugcucuguuuuagagcuagaaauagcaaguuaaaauaaggcuaguccguuaucaacuugaaaaaguggcaccgagucggugcuuuunnn

SEQ ID NO: 1798 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1799 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1800 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1801 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1802 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1803 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1804 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1805 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1806 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1807 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1808 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1809 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1810 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1811 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1812 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1813 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1814 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1815 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1816 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1817 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1818 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1819 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1820 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1821 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1822 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1823 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1824 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1825 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1826 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1827 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1828 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1829 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1830 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1831 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1832 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1833 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1834 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1835 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1836 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1837 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1838 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1839 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1840 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1841 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1842 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1843 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1844 - RNA, 102 nt, Artificial Sequence
  Description of Artificial Sequence: Synthetic polynucleotide
  modified_base (100)..(102): a, c, u, g, unknown or other
gaauaccugaguaacuuucguuuuagagcuagaaauagcaaguuaaaauaaggcuaguccguuaucaacuugaaaaaguggcaccgagucggugcuuuunnn

SEQ ID NO: 1845 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1846 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1847 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1848 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1849 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1850 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1851 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1852 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1853 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1854 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1855 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1856 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1857 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1858 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1859 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1860 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1861 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1862 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1863 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1864 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1865 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1866 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1867 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1868 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1869 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1870 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1871 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1872 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1873 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1874 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1875 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1876 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1877 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1878 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1879 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1880 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1881 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1882 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1883 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1884 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1885 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1886 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1887 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1888 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1889 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1890 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1891 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1892 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1893 - RNA, 103 nt, Artificial Sequence; identical to SEQ ID NO: 1795
  Description of Artificial Sequence: Synthetic polynucleotide
  modified_base (101)..(103): a, c, u, g, unknown or other

SEQ ID NO: 1894 - RNA, 103 nt, Artificial Sequence; identical to SEQ ID NO: 1796
  Description of Artificial Sequence: Synthetic polynucleotide
  modified_base (101)..(103): a, c, u, g, unknown or other

SEQ ID NO: 1895 - RNA, 103 nt, Artificial Sequence; identical to SEQ ID NO: 1797
  Description of Artificial Sequence: Synthetic polynucleotide
  modified_base (101)..(103): a, c, u, g, unknown or other

SEQ ID NO: 1896 - RNA, 100 nt, Artificial Sequence
  Description of Artificial Sequence: Synthetic polynucleotide
  modified_base (9)..(9): Nebularine
  modified_base (14)..(14): Nebularine
cagguuccnugggnugcucuguuuuagagcuagaaauagcaaguuaaaauaaggcuaguccguuaucaacuugaaaaaguggcaccgagucggugcuuuu

SEQ ID NO: 1897 - RNA, 100 nt, Artificial Sequence
  Description of Artificial Sequence: Synthetic polynucleotide
  modified_base (9)..(9): Nebularine
cagguuccnugggaugcucuguuuuagagcuagaaauagcaaguuaaaauaaggcuaguccguuaucaacuugaaaaaguggcaccgagucggugcuuuu

SEQ ID NO: 1898 - RNA, 100 nt, Artificial Sequence
  Description of Artificial Sequence: Synthetic polynucleotide
  modified_base (14)..(14): Nebularine
cagguuccaugggnugcucuguuuuagagcuagaaauagcaaguuaaaauaaggcuaguccguuaucaacuugaaaaaguggcaccgagucggugcuuuu

SEQ ID NO: 1899 - RNA, 100 nt, Artificial Sequence
  Description of Artificial Sequence: Synthetic polynucleotide
  modified_base (34)..(34): Nebularine
cagguuccaugggaugcucuguuuuagagcuagnaauagcaaguuaaaauaaggcuaguccguuaucaacuugaaaaaguggcaccgagucggugcuuuu

SEQ ID NO: 1900 - RNA, 100 nt, Artificial Sequence
  Description of Artificial Sequence: Synthetic polynucleotide
  modified_base (34)..(34): Nebularine
  modified_base (57)..(57): Nebularine
cagguuccaugggaugcucuguuuuagagcuagnaauagcaaguuaaaauaaggcunguccguuaucaacuugaaaaaguggcaccgagucggugcuuuu

SEQ ID NO: 1901 - RNA, 100 nt, Artificial Sequence
  Description of Artificial Sequence: Synthetic polynucleotide
  modified_base (57)..(57): Nebularine
cagguuccaugggaugcucuguuuuagagcuagaaauagcaaguuaaaauaaggcunguccguuaucaacuugaaaaaguggcaccgagucggugcuuuu

SEQ ID NO: 1902 - RNA, 100 nt, Artificial Sequence
  Description of Artificial Sequence: Synthetic polynucleotide
  modified_base (65)..(65): Nebularine
cagguuccaugggaugcucuguuuuagagcuagaaauagcaaguuaaaauaaggcuaguccguunucaacuugaaaaaguggcaccgagucggugcuuuu

SEQ ID NO: 1903 - RNA, 100 nt, Artificial Sequence
  Description of Artificial Sequence: Synthetic polynucleotide
  modified_base (34)..(34): Nebularine
  modified_base (57)..(57): Nebularine
  modified_base (65)..(65): Nebularine
cagguuccaugggaugcucuguuuuagagcuagnaauagcaaguuaaaauaaggcunguccguunucaacuugaaaaaguggcaccgagucggugcuuuu

SEQ ID NO: 1904 - RNA, 100 nt, Artificial Sequence
  Description of Artificial Sequence: Synthetic polynucleotide
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine
cagguuccaugggaugcucuguuuuagngcuagnaauagcanguuaaaauaaggcunguccguunucaacuugaaaaaguggcaccgagucggugcuuuu

SEQ ID NO: 1905 - RNA, 100 nt, Artificial Sequence
  Description of Artificial Sequence: Synthetic polynucleotide
  modified_base (9)..(9): Nebularine
  modified_base (14)..(14): Nebularine
  modified_base (34)..(34): Nebularine
cagguuccnugggnugcucuguuuuagagcuagnaauagcaaguuaaaauaaggcuaguccguuaucaacuugaaaaaguggcaccgagucggugcuuuu

SEQ ID NO: 1906 - RNA, 100 nt, Artificial Sequence
  Description of Artificial Sequence: Synthetic polynucleotide
  modified_base (9)..(9): Nebularine
  modified_base (14)..(14): Nebularine
  modified_base (34)..(34): Nebularine
  modified_base (57)..(57): Nebularine
cagguuccnugggnugcucuguuuuagagcuagnaauagcaaguuaaaauaaggcunguccguuaucaacuugaaaaaguggcaccgagucggugcuuuu

SEQ ID NO: 1907 - RNA, 100 nt, Artificial Sequence
  Description of Artificial Sequence: Synthetic polynucleotide
  modified_base (9)..(9): Nebularine
  modified_base (14)..(14): Nebularine
  modified_base (65)..(65): Nebularine
cagguuccnugggnugcucuguuuuagagcuagaaauagcaaguuaaaauaaggcuaguccguunucaacuugaaaaaguggcaccgagucggugcuuuu

SEQ ID NO: 1908 - RNA, 100 nt, Artificial Sequence
  Description of Artificial Sequence: Synthetic polynucleotide
  modified_base (9)..(9): Nebularine
  modified_base (14)..(14): Nebularine
  modified_base (34)..(34): Nebularine
  modified_base (57)..(57): Nebularine
  modified_base (65)..(65): Nebularine
cagguuccnugggnugcucuguuuuagagcuagnaauagcaaguuaaaauaaggcunguccguunucaacuugaaaaaguggcaccgagucggugcuuuu

SEQ ID NO: 1909 - RNA, 100 nt, Artificial Sequence
  Description of Artificial Sequence: Synthetic polynucleotide
  modified_base (9)..(9): Nebularine
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine
cagguuccnugggnugcucuguuuuagngcuagnaauagcanguuaaaauaaggcunguccguunucaacuugaaaaaguggcaccgagucggugcuuuu

SEQ ID NO: 1910 - RNA, 100 nt, Artificial Sequence
  Description of Artificial Sequence: Synthetic polynucleotide
  modified_base (9)..(9): Nebularine
  modified_base (34)..(34): Nebularine
  modified_base (57)..(57): Nebularine
cagguuccnugggaugcucuguuuuagagcuagnaauagcaaguuaaaauaaggcunguccguuaucaacuugaaaaaguggcaccgagucggugcuuuu

SEQ ID NO: 1911 - RNA, 100 nt, Artificial Sequence
  Description of Artificial Sequence: Synthetic polynucleotide
  modified_base (9)..(9): Nebularine
  modified_base (57)..(57): Nebularine
cagguuccnugggaugcucuguuuuagagcuagaaauagcaaguuaaaauaaggcunguccguuaucaacuugaaaaaguggcaccgagucggugcuuuu

SEQ ID NO: 1912 - RNA, 100 nt, Artificial Sequence
  Description of Artificial Sequence: Synthetic polynucleotide
  modified_base (9)..(9): Nebularine
  modified_base (65)..(65): Nebularine
cagguuccnugggaugcucuguuuuagagcuagaaauagcaaguuaaaauaaggcuaguccguunucaacuugaaaaaguggcaccgagucggugcuuuu

SEQ ID NO: 1913 - RNA, 100 nt, Artificial Sequence
  Description of Artificial Sequence: Synthetic polynucleotide
  modified_base (9)..(9): Nebularine
  modified_base (34)..(34): Nebularine
  modified_base (57)..(57): Nebularine
  modified_base (65)..(65): Nebularine
cagguuccnugggaugcucuguuuuagagcuagnaauagcaaguuaaaauaaggcunguccguunucaacuugaaaaaguggcaccgagucggugcuuuu

SEQ ID NO: 1914 - RNA, 100 nt, Artificial Sequence
  Description of Artificial Sequence: Synthetic polynucleotide
  modified_base (9)..(9): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine
cagguuccnugggaugcucuguuuuagngcuagnaauagcanguuaaaauaaggcunguccguunucaacuugaaaaaguggcaccgagucggugcuuuu

SEQ ID NO: 1915 - RNA, 100 nt, Artificial Sequence
  Description of Artificial Sequence: Synthetic polynucleotide
  modified_base (14)..(14): Nebularine
  modified_base (34)..(34): Nebularine
cagguuccaugggnugcucuguuuuagagcuagnaauagcaaguuaaaauaaggcuaguccguuaucaacuugaaaaaguggcaccgagucggugcuuuu

SEQ ID NO: 1916 - RNA, 100 nt, Artificial Sequence
  Description of Artificial Sequence: Synthetic polynucleotide
  modified_base (14)..(14): Nebularine
  modified_base (34)..(34): Nebularine
  modified_base (57)..(57): Nebularine
cagguuccaugggnugcucuguuuuagagcuagnaauagcaaguuaaaauaaggcunguccguuaucaacuugaaaaaguggcaccgagucggugcuuuu

SEQ ID NO: 1917 - RNA, 100 nt, Artificial Sequence
  Description of Artificial Sequence: Synthetic polynucleotide
  modified_base (14)..(14): Nebularine
  modified_base (57)..(57): Nebularine
cagguuccaugggnugcucuguuuuagagcuagaaauagcaaguuaaaauaaggcunguccguuaucaacuugaaaaaguggcaccgagucggugcuuuu

SEQ ID NO: 1918 - RNA, 100 nt, Artificial Sequence
  Description of Artificial Sequence: Synthetic polynucleotide
  modified_base (14)..(14): Nebularine
  modified_base (65)..(65): Nebularine
cagguuccaugggnugcucuguuuuagagcuagaaauagcaaguuaaaauaaggcuaguccguunucaacuugaaaaaguggcaccgagucggugcuuuu

SEQ ID NO: 1919 - RNA, 100 nt, Artificial Sequence
  Description of Artificial Sequence: Synthetic polynucleotide
  modified_base (14)..(14): Nebularine
  modified_base (34)..(34): Nebularine
  modified_base (57)..(57): Nebularine
  modified_base (65)..(65): Nebularine
cagguuccaugggnugcucuguuuuagagcuagnaauagcaaguuaaaauaaggcunguccguunucaacuugaaaaaguggcaccgagucggugcuuuu

SEQ ID NO: 1920 - RNA, 100 nt, Artificial Sequence
  Description of Artificial Sequence: Synthetic polynucleotide
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine
cagguuccaugggnugcucuguuuuagngcuagnaauagcanguuaaaauaaggcunguccguunucaacuugaaaaaguggcaccgagucggugcuuuu

SEQ ID NO: 1921 - RNA, 100 nt, Artificial Sequence
  Description of Artificial Sequence: Synthetic polynucleotide
  modified_base (9)..(9): Nebularine
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
cagguuccnugggnugcucuguuuuagngcuagnaauagcanguuaaaauaaggcunguccguuaucaacuugaaaaaguggcaccgagucggugcuuuu

SEQ ID NO: 1922 - RNA, 100 nt, Artificial Sequence
  Description of Artificial Sequence: Synthetic polynucleotide
  modified_base (9)..(9): Nebularine
  modified_base (14)..(14): Nebularine
  modified_base (34)..(34): Nebularine
  modified_base (42)..(42): Nebularine
  modified_base (57)..(57): Nebularine
cagguuccnugggnugcucuguuuuagagcuagnaauagcanguuaaaauaaggcunguccguuaucaacuugaaaaaguggcaccgagucggugcuuuu

SEQ ID NO: 1923 - RNA, 100 nt, Artificial Sequence
  Description of Artificial Sequence: Synthetic polynucleotide
  modified_base (9)..(9): Nebularine
  modified_base (14)..(14): Nebularine
  modified_base (42)..(42): Nebularine
  modified_base (57)..(57): Nebularine
cagguuccnugggnugcucuguuuuagagcuagaaauagcanguuaaaauaaggcunguccguuaucaacuugaaaaaguggcaccgagucggugcuuuu

SEQ ID NO: 1924 - RNA, 100 nt, Artificial Sequence
  Description of Artificial Sequence: Synthetic polynucleotide
  modified_base (9)..(9): Nebularine
  modified_base (14)..(14): Nebularine
  modified_base (57)..(57): Nebularine
cagguuccnugggnugcucuguuuuagagcuagaaauagcaaguuaaaauaaggcunguccguuaucaacuugaaaaaguggcaccgagucggugcuuuu

SEQ ID NO: 1925 - RNA, 100 nt, Artificial Sequence
  Description of Artificial Sequence: Synthetic polynucleotide
  modified_base (9)..(9): Nebularine
  modified_base (14)..(14): Nebularine
  modified_base (28)..(28): Nebularine
cagguuccnugggnugcucuguuuuagngcuagaaauagcaaguuaaaauaaggcuaguccguuaucaacuugaaaaaguggcaccgagucggugcuuuu

SEQ ID NO: 1926 - RNA, 100 nt, Artificial Sequence
  Description of Artificial Sequence: Synthetic polynucleotide
  modified_base (9)..(9): Nebularine
  modified_base (14)..(14): Nebularine
  modified_base (42)..(42): Nebularine
cagguuccnugggnugcucuguuuuagagcuagaaauagcanguuaaaauaaggcuaguccguuaucaacuugaaaaaguggcaccgagucggugcuuuu

SEQ ID NO: 1927 - RNA, 100 nt, Artificial Sequence
  Description of Artificial Sequence: Synthetic polynucleotide
  modified_base (9)..(9): Nebularine
  modified_base (14)..(14): Nebularine
  modified_base (34)..(34): Nebularine
  modified_base (42)..(42): Nebularine
cagguuccnugggnugcucuguuuuagagcuagnaauagcanguuaaaauaaggcuaguccguuaucaacuugaaaaaguggcaccgagucggugcuuuu

SEQ ID NO: 1928 - RNA, 100 nt, Artificial Sequence
  Description of Artificial Sequence: Synthetic polynucleotide
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
cagguuccaugggnugcucuguuuuagngcuagnaauagcanguuaaaauaaggcunguccguuaucaacuugaaaaaguggcaccgagucggugcuuuu

SEQ ID NO: 1929 - RNA, 100 nt, Artificial Sequence
  Description of Artificial Sequence: Synthetic polynucleotide
  modified_base (14)..(14): Nebularine
  modified_base (34)..(34): Nebularine
  modified_base (42)..(42): Nebularine
  modified_base (57)..(57): Nebularine
cagguuccaugggnugcucuguuuuagagcuagnaauagcanguuaaaauaaggcunguccguuaucaacuugaaaaaguggcaccgagucggugcuuuu

SEQ ID NO: 1930 - RNA, 100 nt, Artificial Sequence
  Description of Artificial Sequence: Synthetic polynucleotide
  modified_base (14)..(14): Nebularine
  modified_base (42)..(42): Nebularine
  modified_base (57)..(57): Nebularine
cagguuccaugggnugcucuguuuuagagcuagaaauagcanguuaaaauaaggcunguccguuaucaacuugaaaaaguggcaccgagucggugcuuuu

SEQ ID NO: 1931 - RNA, 100 nt, Artificial Sequence
  Description of Artificial Sequence: Synthetic polynucleotide
  modified_base (14)..(14): Nebularine
  modified_base (28)..(28): Nebularine
cagguuccaugggnugcucuguuuuagngcuagaaauagcaaguuaaaauaaggcuaguccguuaucaacuugaaaaaguggcaccgagucggugcuuuu

SEQ ID NO: 1932 - RNA, 100 nt, Artificial Sequence
  Description of Artificial Sequence: Synthetic polynucleotide
  modified_base (14)..(14): Nebularine
  modified_base (42)..(42): Nebularine
cagguuccaugggnugcucuguuuuagagcuagaaauagcanguuaaaauaaggcuaguccguuaucaacuugaaaaaguggcaccgagucggugcuuuu

SEQ ID NO: 1933 - RNA, 100 nt, Artificial Sequence
  Description of Artificial Sequence: Synthetic polynucleotide
  modified_base (14)..(14): Nebularine
  modified_base (34)..(34): Nebularine
  modified_base (42)..(42): Nebularine
cagguuccaugggnugcucuguuuuagagcuagnaauagcanguuaaaauaaggcuaguccguuaucaacuugaaaaaguggcaccgagucggugcuuuu

SEQ ID NO: 1934 - RNA, 100 nt, Artificial Sequence
  Description of Artificial Sequence: Synthetic polynucleotide
  modified_base (9)..(9): Nebularine
  modified_base (28)..(28): Nebularine
  modified_base (34)..(34): Nebularine
  modified_base (42)..(42): Nebularine
  modified_base (57)..(57): Nebularine
cagguuccnugggaugcucuguuuuagngcuagnaauagcanguuaaaauaaggcunguccguuaucaacuugaaaaaguggcaccgagucggugcuuuu

SEQ ID NO: 1935 - RNA, 100 nt, Artificial Sequence
  Description of Artificial Sequence: Synthetic polynucleotide
  modified_base (9)..(9): Nebularine
  modified_base (34)..(34): Nebularine
  modified_base (42)..(42): Nebularine
  modified_base (57)..(57): Nebularine
cagguuccnugggaugcucuguuuuagagcuagnaauagcanguuaaaauaaggcunguccguuaucaacuugaaaaaguggcaccgagucggugcuuuu

SEQ ID NO: 1936 - RNA, 100 nt, Artificial Sequence
  Description of Artificial Sequence: Synthetic polynucleotide
  modified_base (9)..(9): Nebularine
  modified_base (42)..(42): Nebularine
  modified_base (57)..(57): Nebularine
cagguuccnugggaugcucuguuuuagagcuagaaauagcanguuaaaauaaggcunguccguuaucaacuugaaaaaguggcaccgagucggugcuuuu

SEQ ID NO: 1937 - RNA, 100 nt, Artificial Sequence
  Description of Artificial Sequence: Synthetic polynucleotide
  modified_base (9)..(9): Nebularine
  modified_base (28)..(28): Nebularine
cagguuccnugggaugcucuguuuuagngcuagaaauagcaaguuaaaauaaggcuaguccguuaucaacuugaaaaaguggcaccgagucggugcuuuu

SEQ ID NO: 1938 - RNA, 100 nt, Artificial Sequence
  Description of Artificial Sequence: Synthetic polynucleotide
  modified_base (9)..(9): Nebularine
  modified_base (42)..(42): Nebularine
cagguuccnugggaugcucuguuuuagagcuagaaauagcanguuaaaauaaggcuaguccguuaucaacuugaaaaaguggcaccgagucggugcuuuu

SEQ ID NO: 1939 - RNA, 100 nt, Artificial Sequence
  Description of Artificial Sequence: Synthetic polynucleotide
  modified_base (9)..(9): Nebularine
  modified_base (34)..(34): Nebularine
  modified_base (42)..(42): Nebularine
cagguuccnugggaugcucuguuuuagagcuagnaauagcanguuaaaauaaggcuaguccguuaucaacuugaaaaaguggcaccgagucggugcuuuu

SEQ ID NO: 1940 - RNA, 100 nt, Artificial Sequence
  Description of Artificial Sequence: Synthetic polynucleotide
  modified_base (9)..(9): Nebularine
  modified_base (34)..(34): Nebularine
cagguuccnugggaugcucuguuuuagagcuagnaauagcaaguuaaaauaaggcuaguccguuaucaacuugaaaaaguggcaccgagucggugcuuuu

SEQ ID NO: 1941 - DNA, 100 bp, Artificial Sequence
  Description of Artificial Sequence: Synthetic oligonucleotide
  Description of Combined DNA/RNA Molecule: Synthetic oligonucleotide
  modified_base (9)..(9): Nebularine
  modified_base (14)..(14): Nebularine
cagguuccnugggnugcucuguuuuagagcuagaaauagcaaguuaaaauaaggcuaguccguuaucaacuugaaaaaguggcaccgagucggugcuuuu

SEQ ID NO: 1942 - DNA, 100 bp, Artificial Sequence
  Description of Artificial Sequence: Synthetic oligonucleotide
  Description of Combined DNA/RNA Molecule: Synthetic oligonucleotide
  modified_base (9)..(9): Nebularine
cagguuccnugggaugcucuguuuuagagcuagaaauagcaaguuaaaauaaggcuaguccguuaucaacuugaaaaaguggcaccgagucggugcuuuu

SEQ ID NO: 1943 - DNA, 100 bp, Artificial Sequence
  Description of Artificial Sequence: Synthetic oligonucleotide
  Description of Combined DNA/RNA Molecule: Synthetic oligonucleotide
  modified_base (14)..(14): Nebularine
cagguuccaugggnugcucuguuuuagagcuagaaauagcaaguuaaaauaaggcuaguccguuaucaacuugaaaaaguggcaccgagucggugcuuuu

SEQ ID NO: 1944 - DNA, 100 bp, Artificial Sequence
  Description of Artificial Sequence: Synthetic oligonucleotide
  Description of Combined DNA/RNA Molecule: Synthetic oligonucleotide
  modified_base (34)..(34): Nebularine
cagguuccaugggaugcucuguuuuagagcuagnaauagcaaguuaaaauaaggcuaguccguuaucaacuugaaaaaguggcaccgagucggugcuuuu

SEQ ID NO: 1945 - DNA, 100 bp, Artificial Sequence
  Description of Artificial Sequence: Synthetic oligonucleotide
  Description of Combined DNA/RNA Molecule: Synthetic oligonucleotide
  modified_base (34)..(34): Nebularine
  modified_base (57)..(57): Nebularine
cagguuccaugggaugcucuguuuuagagcuagnaauagcaaguuaaaauaaggcunguccguuaucaacuugaaaaaguggcaccgagucggugcuuuu

SEQ ID NO: 1946 - DNA, 100 bp, Artificial Sequence
  Description of Artificial Sequence: Synthetic oligonucleotide
  Description of Combined DNA/RNA Molecule: Synthetic oligonucleotide
  modified_base (57)..(57): Nebularine
cagguuccaugggaugcucuguuuuagagcuagaaauagcaaguuaaaauaaggcunguccguuaucaacuugaaaaaguggcaccgagucggugcuuuu

SEQ ID NO: 1947 - DNA, 100 bp, Artificial Sequence
  Description of Artificial Sequence: Synthetic oligonucleotide
  Description of Combined DNA/RNA Molecule: Synthetic oligonucleotide
  modified_base (65)..(65): Nebularine
cagguuccaugggaugcucuguuuuagagcuagaaauagcaaguuaaaauaaggcuaguccguunucaacuugaaaaaguggcaccgagucggugcuuuu

SEQ ID NO: 1948 - DNA, 100 bp, Artificial Sequence
  Description of Artificial Sequence: Synthetic oligonucleotide
  Description of Combined DNA/RNA Molecule: Synthetic oligonucleotide
  modified_base (34)..(34): Nebularine
  modified_base (57)..(57): Nebularine
  modified_base (65)..(65): Nebularine
cagguuccaugggaugcucuguuuuagagcuagnaauagcaaguuaaaauaaggcunguccguunucaacuugaaaaaguggcaccgagucggugcuuuu

SEQ ID NO: 1949 - DNA, 100 bp, Artificial Sequence
  Description of Artificial Sequence: Synthetic oligonucleotide
  Description of Combined DNA/RNA Molecule: Synthetic oligonucleotide
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine
cagguuccaugggaugcucuguuuuagngcuagnaauagcanguuaaaauaaggcunguccguunucaacuugaaaaaguggcaccgagucggugcuuuu

SEQ ID NO: 1950 - RNA, 100 nt, Artificial Sequence; identical to SEQ ID NO: 1896
  Description of Artificial Sequence: Synthetic polynucleotide
  modified_base (9)..(9): Nebularine
  modified_base (14)..(14): Nebularine

SEQ ID NO: 1951 - RNA, 100 nt, Artificial Sequence; identical to SEQ ID NO: 1897
  Description of Artificial Sequence: Synthetic polynucleotide
  modified_base (9)..(9): Nebularine

SEQ ID NO: 1952 - RNA, 100 nt, Artificial Sequence; identical to SEQ ID NO: 1898
  Description of Artificial Sequence: Synthetic polynucleotide
  modified_base (14)..(14): Nebularine

SEQ ID NO: 1953 - RNA, 100 nt, Artificial Sequence; identical to SEQ ID NO: 1899
  Description of Artificial Sequence: Synthetic polynucleotide
  modified_base (34)..(34): Nebularine

SEQ ID NO: 1954 - RNA, 100 nt, Artificial Sequence; identical to SEQ ID NO: 1900
  Description of Artificial Sequence: Synthetic polynucleotide
  modified_base (34)..(34): Nebularine
  modified_base (57)..(57): Nebularine

SEQ ID NO: 1955 - RNA, 100 nt, Artificial Sequence; identical to SEQ ID NO: 1901
  Description of Artificial Sequence: Synthetic polynucleotide
  modified_base (57)..(57): Nebularine

SEQ ID NO: 1956 - RNA, 100 nt, Artificial Sequence; identical to SEQ ID NO: 1902
  Description of Artificial Sequence: Synthetic polynucleotide
  modified_base (65)..(65): Nebularine

SEQ ID NO: 1957 - RNA, 100 nt, Artificial Sequence; identical to SEQ ID NO: 1903
  Description of Artificial Sequence: Synthetic polynucleotide
  modified_base (34)..(34): Nebularine
  modified_base (57)..(57): Nebularine
  modified_base (65)..(65): Nebularine

SEQ ID NO: 1958 - RNA, 100 nt, Artificial Sequence; identical to SEQ ID NO: 1904
  Description of Artificial Sequence: Synthetic polynucleotide
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 1959 - RNA, 100 nt, Artificial Sequence; identical to SEQ ID NO: 1905
  Description of Artificial Sequence: Synthetic polynucleotide
  modified_base (9)..(9): Nebularine
  modified_base (14)..(14): Nebularine
  modified_base (34)..(34): Nebularine

SEQ ID NO: 1960 - RNA, 100 nt, Artificial Sequence; identical to SEQ ID NO: 1906
  Description of Artificial Sequence: Synthetic polynucleotide
  modified_base (9)..(9): Nebularine
  modified_base (14)..(14): Nebularine
  modified_base (34)..(34): Nebularine
  modified_base (57)..(57): Nebularine

SEQ ID NO: 1961 - RNA, 100 nt, Artificial Sequence; identical to SEQ ID NO: 1907
  Description of Artificial Sequence: Synthetic polynucleotide
  modified_base (9)..(9): Nebularine
  modified_base (14)..(14): Nebularine
  modified_base (65)..(65): Nebularine

SEQ ID NO: 1962 - RNA, 100 nt, Artificial Sequence; identical to SEQ ID NO: 1908
  Description of Artificial Sequence: Synthetic polynucleotide
  modified_base (9)..(9): Nebularine
  modified_base (14)..(14): Nebularine
  modified_base (34)..(34): Nebularine
  modified_base (57)..(57): Nebularine
  modified_base (65)..(65): Nebularine

SEQ ID NO: 1963 - RNA, 100 nt, Artificial Sequence; identical to SEQ ID NO: 1909
  Description of Artificial Sequence: Synthetic polynucleotide
  modified_base (9)..(9): Nebularine
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 1964 - RNA, 100 nt, Artificial Sequence; identical to SEQ ID NO: 1910
  Description of Artificial Sequence: Synthetic polynucleotide
  modified_base (9)..(9): Nebularine
  modified_base (34)..(34): Nebularine
  modified_base (57)..(57): Nebularine

SEQ ID NO: 1965 - RNA, 100 nt, Artificial Sequence; identical to SEQ ID NO: 1911
  Description of Artificial Sequence: Synthetic polynucleotide
  modified_base (9)..(9): Nebularine
  modified_base (57)..(57): Nebularine

SEQ ID NO: 1966 - RNA, 100 nt, Artificial Sequence; identical to SEQ ID NO: 1912
  Description of Artificial Sequence: Synthetic polynucleotide
  modified_base (9)..(9): Nebularine
  modified_base (65)..(65): Nebularine

SEQ ID NO: 1967 - RNA, 100 nt, Artificial Sequence; identical to SEQ ID NO: 1913
  Description of Artificial Sequence: Synthetic polynucleotide
  modified_base (9)..(9): Nebularine
  modified_base (34)..(34): Nebularine
  modified_base (57)..(57): Nebularine
  modified_base (65)..(65): Nebularine

SEQ ID NO: 1968 - RNA, 100 nt, Artificial Sequence; identical to SEQ ID NO: 1914
  Description of Artificial Sequence: Synthetic polynucleotide
  modified_base (9)..(9): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 1969 - RNA, 100 nt, Artificial Sequence; identical to SEQ ID NO: 1915
  Description of Artificial Sequence: Synthetic polynucleotide
  modified_base (14)..(14): Nebularine
  modified_base (34)..(34): Nebularine

SEQ ID NO: 1970 - RNA, 100 nt, Artificial Sequence; identical to SEQ ID NO: 1916
  Description of Artificial Sequence: Synthetic polynucleotide
  modified_base (14)..(14): Nebularine
  modified_base (34)..(34): Nebularine
  modified_base (57)..(57): Nebularine

SEQ ID NO: 1971 - RNA, 100 nt, Artificial Sequence; identical to SEQ ID NO: 1917
  Description of Artificial Sequence: Synthetic polynucleotide
  modified_base (14)..(14): Nebularine
  modified_base (57)..(57): Nebularine

SEQ ID NO: 1972 - RNA, 100 nt, Artificial Sequence; identical to SEQ ID NO: 1918
  Description of Artificial Sequence: Synthetic polynucleotide
  modified_base (14)..(14): Nebularine
  modified_base (65)..(65): Nebularine

SEQ ID NO: 1973 - RNA, 100 nt, Artificial Sequence; identical to SEQ ID NO: 1919
  Description of Artificial Sequence: Synthetic polynucleotide
  modified_base (14)..(14): Nebularine
  modified_base (34)..(34): Nebularine
  modified_base (57)..(57): Nebularine
  modified_base (65)..(65): Nebularine

SEQ ID NO: 1974 - RNA, 100 nt, Artificial Sequence; identical to SEQ ID NO: 1920
  Description of Artificial Sequence: Synthetic polynucleotide
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 1975 - RNA, 100 nt, Artificial Sequence; identical to SEQ ID NO: 1921
  Description of Artificial Sequence: Synthetic polynucleotide
  modified_base (9)..(9): Nebularine
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine

SEQ ID NO: 1976 - RNA, 100 nt, Artificial Sequence; identical to SEQ ID NO: 1922
  Description of Artificial Sequence: Synthetic polynucleotide
  modified_base (9)..(9): Nebularine
  modified_base (14)..(14): Nebularine
  modified_base (34)..(34): Nebularine
  modified_base (42)..(42): Nebularine
  modified_base (57)..(57): Nebularine

SEQ ID NO: 1977 - RNA, 100 nt, Artificial Sequence; identical to SEQ ID NO: 1923
  Description of Artificial Sequence: Synthetic polynucleotide
  modified_base (9)..(9): Nebularine
  modified_base (14)..(14): Nebularine
  modified_base (42)..(42): Nebularine
  modified_base (57)..(57): Nebularine

SEQ ID NO: 1978 - RNA, 100 nt, Artificial Sequence; identical to SEQ ID NO: 1924
  Description of Artificial Sequence: Synthetic polynucleotide
  modified_base (9)..(9): Nebularine
  modified_base (14)..(14): Nebularine
  modified_base (57)..(57): Nebularine

SEQ ID NO: 1979 - RNA, 100 nt, Artificial Sequence; identical to SEQ ID NO: 1925
  Description of Artificial Sequence: Synthetic polynucleotide
  modified_base (9)..(9): Nebularine
  modified_base (14)..(14): Nebularine
  modified_base (28)..(28): Nebularine

SEQ ID NO: 1980 - RNA, 100 nt, Artificial Sequence; identical to SEQ ID NO: 1926
  Description of Artificial Sequence: Synthetic polynucleotide
  modified_base (9)..(9): Nebularine
  modified_base (14)..(14): Nebularine
  modified_base (42)..(42): Nebularine

SEQ ID NO: 1981 - RNA, 100 nt, Artificial Sequence; identical to SEQ ID NO: 1927
  Description of Artificial Sequence: Synthetic polynucleotide
  modified_base (9)..(9): Nebularine
  modified_base (14)..(14): Nebularine
  modified_base (34)..(34): Nebularine
  modified_base (42)..(42): Nebularine

SEQ ID NO: 1982 - RNA, 100 nt, Artificial Sequence; identical to SEQ ID NO: 1928
  Description of Artificial Sequence: Synthetic polynucleotide
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine

SEQ ID NO: 1983 - RNA, 100 nt, Artificial Sequence; identical to SEQ ID NO: 1930
  Description of Artificial Sequence: Synthetic polynucleotide
  modified_base (14)..(14): Nebularine
  modified_base (42)..(42): Nebularine
  modified_base (57)..(57): Nebularine

SEQ ID NO: 1984 - RNA, 100 nt, Artificial Sequence; identical to SEQ ID NO: 1931
  Description of Artificial Sequence: Synthetic polynucleotide
  modified_base (14)..(14): Nebularine
  modified_base (28)..(28): Nebularine

SEQ ID NO: 1985 - RNA, 100 nt, Artificial Sequence; identical to SEQ ID NO: 1932
  Description of Artificial Sequence: Synthetic polynucleotide
  modified_base (14)..(14): Nebularine
  modified_base (42)..(42): Nebularine

SEQ ID NO: 1986 - RNA, 100 nt, Artificial Sequence; identical to SEQ ID NO: 1933
  Description of Artificial Sequence: Synthetic polynucleotide
  modified_base (14)..(14): Nebularine
  modified_base (34)..(34): Nebularine
  modified_base (42)..(42): Nebularine

SEQ ID NO: 1987 - RNA, 100 nt, Artificial Sequence; identical to SEQ ID NO: 1934
  Description of Artificial Sequence: Synthetic polynucleotide
  modified_base (9)..(9): Nebularine
  modified_base (28)..(28): Nebularine
  modified_base (34)..(34): Nebularine
  modified_base (42)..(42): Nebularine
  modified_base (57)..(57): Nebularine

SEQ ID NO: 1988 - RNA, 100 nt, Artificial Sequence; identical to SEQ ID NO: 1935
  Description of Artificial Sequence: Synthetic polynucleotide
  modified_base (9)..(9): Nebularine
  modified_base (34)..(34): Nebularine
  modified_base (42)..(42): Nebularine
  modified_base (57)..(57): Nebularine

SEQ ID NO: 1989 - RNA, 100 nt, Artificial Sequence; identical to SEQ ID NO: 1936
  Description of Artificial Sequence: Synthetic polynucleotide
  modified_base (9)..(9): Nebularine
  modified_base (42)..(42): Nebularine
  modified_base (57)..(57): Nebularine

SEQ ID NO: 1990 - RNA, 100 nt, Artificial Sequence; identical to SEQ ID NO: 1937
  Description of Artificial Sequence: Synthetic polynucleotide
  modified_base (9)..(9): Nebularine
  modified_base (28)..(28): Nebularine

SEQ ID NO: 1991 - RNA, 100 nt, Artificial Sequence; identical to SEQ ID NO: 1938
  Description of Artificial Sequence: Synthetic polynucleotide
  modified_base (9)..(9): Nebularine
  modified_base (42)..(42): Nebularine

SEQ ID NO: 1992 - RNA, 100 nt, Artificial Sequence; identical to SEQ ID NO: 1939
  Description of Artificial Sequence: Synthetic polynucleotide
  modified_base (9)..(9): Nebularine
  modified_base (34)..(34): Nebularine
  modified_base (42)..(42): Nebularine

SEQ ID NO: 1993 - RNA, 100 nt, Artificial Sequence; identical to SEQ ID NO: 1940
  Description of Artificial Sequence: Synthetic polynucleotide
  modified_base (9)..(9): Nebularine
  modified_base (34)..(34): Nebularine

SEQ ID NO: 1994 - DNA, 100 bp, Artificial Sequence; identical to SEQ ID NO: 1941
  Description of Artificial Sequence: Synthetic oligonucleotide
  Description of Combined DNA/RNA Molecule: Synthetic oligonucleotide
  modified_base (9)..(9): Nebularine
  modified_base (14)..(14): Nebularine

SEQ ID NO: 1995 - DNA, 100 bp, Artificial Sequence; identical to SEQ ID NO: 1942
  Description of Artificial Sequence: Synthetic oligonucleotide
  Description of Combined DNA/RNA Molecule: Synthetic oligonucleotide
  modified_base (9)..(9): Nebularine

SEQ ID NO: 1996 - DNA, 100 bp, Artificial Sequence; identical to SEQ ID NO: 1943
  Description of Artificial Sequence: Synthetic oligonucleotide
  Description of Combined DNA/RNA Molecule: Synthetic oligonucleotide
  modified_base (14)..(14): Nebularine

SEQ ID NO: 1997 - DNA, 100 bp, Artificial Sequence; identical to SEQ ID NO: 1944
  Description of Artificial Sequence: Synthetic oligonucleotide
  Description of Combined DNA/RNA Molecule: Synthetic oligonucleotide
  modified_base (34)..(34): Nebularine

SEQ ID NO: 1998 - DNA, 100 bp, Artificial Sequence; identical to SEQ ID NO: 1945
  Description of Artificial Sequence: Synthetic oligonucleotide
  Description of Combined DNA/RNA Molecule: Synthetic oligonucleotide
  modified_base (34)..(34): Nebularine
  modified_base (57)..(57): Nebularine

SEQ ID NO: 1999 - DNA, 100 bp, Artificial Sequence; identical to SEQ ID NO: 1946
  Description of Artificial Sequence: Synthetic oligonucleotide
  Description of Combined DNA/RNA Molecule: Synthetic oligonucleotide
  modified_base (57)..(57): Nebularine

SEQ ID NO: 2000 - DNA, 100 bp, Artificial Sequence; identical to SEQ ID NO: 1947
  Description of Artificial Sequence: Synthetic oligonucleotide
  Description of Combined DNA/RNA Molecule: Synthetic oligonucleotide
  modified_base (65)..(65): Nebularine

SEQ ID NO: 2001 - DNA, 100 bp, Artificial Sequence; identical to SEQ ID NO: 1948
  Description of Artificial Sequence: Synthetic oligonucleotide
  Description of Combined DNA/RNA Molecule: Synthetic oligonucleotide
  modified_base (34)..(34): Nebularine
  modified_base (57)..(57): Nebularine
  modified_base (65)..(65): Nebularine

SEQ ID NO: 2002 - DNA, 100 bp, Artificial Sequence; identical to SEQ ID NO: 1949
  Description of Artificial Sequence: Synthetic oligonucleotide
  Description of Combined DNA/RNA Molecule: Synthetic oligonucleotide
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2003 - RNA, 100 nt, Artificial Sequence; identical to SEQ ID NO: 1896
  Description of Artificial Sequence: Synthetic polynucleotide
  modified_base (9)..(9): Nebularine
  modified_base (14)..(14): Nebularine

SEQ ID NO: 2004 - RNA, 100 nt, Artificial Sequence; identical to SEQ ID NO: 1897
  Description of Artificial Sequence: Synthetic polynucleotide
  modified_base (9)..(9): Nebularine

SEQ ID NO: 2005 - RNA, 100 nt, Artificial Sequence; identical to SEQ ID NO: 1898
  Description of Artificial Sequence: Synthetic polynucleotide
  modified_base (14)..(14): Nebularine

SEQ ID NO: 2006 - RNA, 100 nt, Artificial Sequence; identical to SEQ ID NO: 1899
  Description of Artificial Sequence: Synthetic polynucleotide
  modified_base (34)..(34): Nebularine

SEQ ID NO: 2007 - RNA, 100 nt, Artificial Sequence; identical to SEQ ID NO: 1900
  Description of Artificial Sequence: Synthetic polynucleotide
  modified_base (34)..(34): Nebularine
  modified_base (57)..(57): Nebularine

SEQ ID NO: 2008 - RNA, 100 nt, Artificial Sequence; identical to SEQ ID NO: 1901
  Description of Artificial Sequence: Synthetic polynucleotide
  modified_base (57)..(57): Nebularine

SEQ ID NO: 2009 - RNA, 100 nt, Artificial Sequence; identical to SEQ ID NO: 1902
  Description of Artificial Sequence: Synthetic polynucleotide
  modified_base (65)..(65): Nebularine

SEQ ID NO: 2010 - RNA, 100 nt, Artificial Sequence; identical to SEQ ID NO: 1903
  Description of Artificial Sequence: Synthetic polynucleotide
  modified_base (34)..(34): Nebularine
  modified_base (57)..(57): Nebularine
  modified_base (65)..(65): Nebularine

SEQ ID NO: 2011 - RNA, 100 nt, Artificial Sequence; identical to SEQ ID NO: 1904
  Description of Artificial Sequence: Synthetic polynucleotide
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2012 - RNA, 100 nt, Artificial Sequence; identical to SEQ ID NO: 1905
  Description of Artificial Sequence: Synthetic polynucleotide
  modified_base (9)..(9): Nebularine
  modified_base (14)..(14): Nebularine
  modified_base (34)..(34): Nebularine

SEQ ID NO: 2013 - RNA, 100 nt, Artificial Sequence; identical to SEQ ID NO: 1906
  Description of Artificial Sequence: Synthetic polynucleotide
  modified_base (9)..(9): Nebularine
  modified_base (14)..(14): Nebularine
  modified_base (34)..(34): Nebularine
  modified_base (57)..(57): Nebularine

SEQ ID NO: 2014 - RNA, 100 nt, Artificial Sequence; identical to SEQ ID NO: 1907
  Description of Artificial Sequence: Synthetic polynucleotide
  modified_base (9)..(9): Nebularine
  modified_base (14)..(14): Nebularine
  modified_base (65)..(65): Nebularine

SEQ ID NO: 2015 - RNA, 100 nt, Artificial Sequence; identical to SEQ ID NO: 1908
  Description of Artificial Sequence: Synthetic polynucleotide
  modified_base (9)..(9): Nebularine
  modified_base (14)..(14): Nebularine
  modified_base (34)..(34): Nebularine
  modified_base (57)..(57): Nebularine
  modified_base (65)..(65): Nebularine

SEQ ID NO: 2016 - RNA, 100 nt, Artificial Sequence; identical to SEQ ID NO: 1909
  Description of Artificial Sequence: Synthetic polynucleotide
  modified_base (9)..(9): Nebularine
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2017 - RNA, 100 nt, Artificial Sequence; identical to SEQ ID NO: 1910
  Description of Artificial Sequence: Synthetic polynucleotide
  modified_base (9)..(9): Nebularine
  modified_base (34)..(34): Nebularine
  modified_base (57)..(57): Nebularine

SEQ ID NO: 2018 - RNA, 100 nt, Artificial Sequence; identical to SEQ ID NO: 1911
  Description of Artificial Sequence: Synthetic polynucleotide
  modified_base (9)..(9): Nebularine
  modified_base (57)..(57): Nebularine

SEQ ID NO: 2019 - RNA, 100 nt, Artificial Sequence; identical to SEQ ID NO: 1912
  Description of Artificial Sequence: Synthetic polynucleotide
  modified_base (9)..(9): Nebularine
  modified_base (65)..(65): Nebularine

SEQ ID NO: 2020 - RNA, 100 nt, Artificial Sequence; identical to SEQ ID NO: 1913
  Description of Artificial Sequence: Synthetic polynucleotide
  modified_base (9)..(9): Nebularine
  modified_base (34)..(34): Nebularine
  modified_base (57)..(57): Nebularine
  modified_base (65)..(65): Nebularine

SEQ ID NO: 2021 - RNA, 100 nt, Artificial Sequence; identical to SEQ ID NO: 1914
  Description of Artificial Sequence: Synthetic polynucleotide
  modified_base (9)..(9): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2022 - RNA, 100 nt, Artificial Sequence; identical to SEQ ID NO: 1915
  Description of Artificial Sequence: Synthetic polynucleotide
  modified_base (14)..(14): Nebularine
  modified_base (34)..(34): Nebularine

SEQ ID NO: 2023 - RNA, 100 nt, Artificial Sequence; identical to SEQ ID NO: 1916
  Description of Artificial Sequence: Synthetic polynucleotide
  modified_base (14)..(14): Nebularine
  modified_base (34)..(34): Nebularine
  modified_base (57)..(57): Nebularine

SEQ ID NO: 2024 - RNA, 100 nt, Artificial Sequence; identical to SEQ ID NO: 1917
  Description of Artificial Sequence: Synthetic polynucleotide
  modified_base (14)..(14): Nebularine
  modified_base (57)..(57): Nebularine

SEQ ID NO: 2025 - RNA, 100 nt, Artificial Sequence; identical to SEQ ID NO: 1918
  Description of Artificial Sequence: Synthetic polynucleotide
  modified_base (14)..(14): Nebularine
  modified_base (65)..(65): Nebularine

SEQ ID NO: 2026 - RNA, 100 nt, Artificial Sequence; identical to SEQ ID NO: 1919
  Description of Artificial Sequence: Synthetic polynucleotide
  modified_base (14)..(14): Nebularine
  modified_base (34)..(34): Nebularine
  modified_base (57)..(57): Nebularine
  modified_base (65)..(65): Nebularine

SEQ ID NO: 2027 - RNA, 100 nt, Artificial Sequence; identical to SEQ ID NO: 1920
  Description of Artificial Sequence: Synthetic polynucleotide
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2028 - RNA, 100 nt, Artificial Sequence; identical to SEQ ID NO: 1921
  Description of Artificial Sequence: Synthetic polynucleotide
  modified_base (9)..(9): Nebularine
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine

SEQ ID NO: 2029 - RNA, 100 nt, Artificial Sequence; identical to SEQ ID NO: 1922
  Description of Artificial Sequence: Synthetic polynucleotide
  modified_base (9)..(9): Nebularine
  modified_base (14)..(14): Nebularine
  modified_base (34)..(34): Nebularine
  modified_base (42)..(42): Nebularine
  modified_base (57)..(57): Nebularine

SEQ ID NO: 2030 - RNA, 100 nt, Artificial Sequence; identical to SEQ ID NO: 1923
  Description of Artificial Sequence: Synthetic polynucleotide
  modified_base (9)..(9): Nebularine
  modified_base (14)..(14): Nebularine
  modified_base (42)..(42): Nebularine
  modified_base (57)..(57): Nebularine

SEQ ID NO: 2031 - RNA, 100 nt, Artificial Sequence; identical to SEQ ID NO: 1924
  Description of Artificial Sequence: Synthetic polynucleotide
  modified_base (9)..(9): Nebularine
  modified_base (14)..(14): Nebularine
  modified_base (57)..(57): Nebularine

SEQ ID NO: 2032 - RNA, 100 nt, Artificial Sequence; identical to SEQ ID NO: 1925
  Description of Artificial Sequence: Synthetic polynucleotide
  modified_base (9)..(9): Nebularine
  modified_base (14)..(14): Nebularine
  modified_base (28)..(28): Nebularine

SEQ ID NO: 2033 - RNA, 100 nt, Artificial Sequence; identical to SEQ ID NO: 1926
  Description of Artificial Sequence: Synthetic polynucleotide
  modified_base (9)..(9): Nebularine
  modified_base (14)..(14): Nebularine
  modified_base (42)..(42): Nebularine

SEQ ID NO: 2034 - RNA, 100 nt, Artificial Sequence; identical to SEQ ID NO: 1927
  Description of Artificial Sequence: Synthetic polynucleotide
  modified_base (9)..(9): Nebularine
  modified_base (14)..(14): Nebularine
  modified_base (34)..(34): Nebularine
  modified_base (42)..(42): Nebularine

SEQ ID NO: 2035 - RNA, 100 nt, Artificial Sequence; identical to SEQ ID NO: 1928
  Description of Artificial Sequence: Synthetic polynucleotide
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine

SEQ ID NO: 2036 - RNA, 100 nt, Artificial Sequence; identical to SEQ ID NO: 1929
  Description of Artificial Sequence: Synthetic polynucleotide
  modified_base (14)..(14): Nebularine
  modified_base (34)..(34): Nebularine
  modified_base (42)..(42): Nebularine
  modified_base (57)..(57): Nebularine

SEQ ID NO: 2037 - RNA, 100 nt, Artificial Sequence; identical to SEQ ID NO: 1930
  Description of Artificial Sequence: Synthetic polynucleotide
  modified_base (14)..(14): Nebularine
  modified_base (42)..(42): Nebularine
  modified_base (57)..(57): Nebularine

SEQ ID NO: 2038 - RNA, 100 nt, Artificial Sequence; identical to SEQ ID NO: 1931
  Description of Artificial Sequence: Synthetic polynucleotide
  modified_base (14)..(14): Nebularine
  modified_base (28)..(28): Nebularine

SEQ ID NO: 2039 - RNA, 100 nt, Artificial Sequence; identical to SEQ ID NO: 1932
  Description of Artificial Sequence: Synthetic polynucleotide
  modified_base (14)..(14): Nebularine
  modified_base (42)..(42): Nebularine

SEQ ID NO: 2040 - RNA, 100 nt, Artificial Sequence; identical to SEQ ID NO: 1933
  Description of Artificial Sequence: Synthetic polynucleotide
  modified_base (14)..(14): Nebularine
  modified_base (34)..(34): Nebularine
  modified_base (42)..(42): Nebularine

SEQ ID NO: 2041 - RNA, 100 nt, Artificial Sequence; identical to SEQ ID NO: 1934
  Description of Artificial Sequence: Synthetic polynucleotide
  modified_base (9)..(9): Nebularine
  modified_base (28)..(28): Nebularine
  modified_base (34)..(34): Nebularine
  modified_base (42)..(42): Nebularine
  modified_base (57)..(57): Nebularine

SEQ ID NO: 2042 - RNA, 100 nt, Artificial Sequence; identical to SEQ ID NO: 1935
  Description of Artificial Sequence: Synthetic polynucleotide
  modified_base (9)..(9): Nebularine
  modified_base (34)..(34): Nebularine
  modified_base (42)..(42): Nebularine
  modified_base (57)..(57): Nebularine

SEQ ID NO: 2043 - RNA, 100 nt, Artificial Sequence; identical to SEQ ID NO: 1936
  Description of Artificial Sequence: Synthetic polynucleotide
  modified_base (9)..(9): Nebularine
  modified_base (42)..(42): Nebularine
  modified_base (57)..(57): Nebularine

SEQ ID NO: 2044 - RNA, 100 nt, Artificial Sequence; identical to SEQ ID NO: 1937
  Description of Artificial Sequence: Synthetic polynucleotide
  modified_base (9)..(9): Nebularine
  modified_base (28)..(28): Nebularine

SEQ ID NO: 2045 - RNA, 100 nt, Artificial Sequence; identical to SEQ ID NO: 1938
  Description of Artificial Sequence: Synthetic polynucleotide
  modified_base (9)..(9): Nebularine
  modified_base (42)..(42): Nebularine

SEQ ID NO: 2046 - RNA, 100 nt, Artificial Sequence; identical to SEQ ID NO: 1939
  Description of Artificial Sequence: Synthetic polynucleotide
  modified_base (9)..(9): Nebularine
  modified_base (34)..(34): Nebularine
  modified_base (42)..(42): Nebularine

SEQ ID NO: 2047 - RNA, 100 nt, Artificial Sequence; identical to SEQ ID NO: 1940
  Description of Artificial Sequence: Synthetic polynucleotide
  modified_base (9)..(9): Nebularine
  modified_base (34)..(34): Nebularine

SEQ ID NO: 2048 - DNA, 100 bp, Artificial Sequence; identical to SEQ ID NO: 1941
  Description of Artificial Sequence: Synthetic oligonucleotide
  Description of Combined DNA/RNA Molecule: Synthetic oligonucleotide
  modified_base (9)..(9): Nebularine
  modified_base (14)..(14): Nebularine

SEQ ID NO: 2049 - DNA, 100 bp, Artificial Sequence; identical to SEQ ID NO: 1942
  Description of Artificial Sequence: Synthetic oligonucleotide
  Description of Combined DNA/RNA Molecule: Synthetic oligonucleotide
  modified_base (9)..(9): Nebularine

SEQ ID NO: 2050 - DNA, 100 bp, Artificial Sequence; identical to SEQ ID NO: 1943
  Description of Artificial Sequence: Synthetic oligonucleotide
  Description of Combined DNA/RNA Molecule: Synthetic oligonucleotide
  modified_base (14)..(14): Nebularine

SEQ ID NO: 2051 - DNA, 100 bp, Artificial Sequence; identical to SEQ ID NO: 1944
  Description of Artificial Sequence: Synthetic oligonucleotide
  Description of Combined DNA/RNA Molecule: Synthetic oligonucleotide
  modified_base (34)..(34): Nebularine

SEQ ID NO: 2052 - DNA, 100 bp, Artificial Sequence; identical to SEQ ID NO: 1945
  Description of Artificial Sequence: Synthetic oligonucleotide
  Description of Combined DNA/RNA Molecule: Synthetic oligonucleotide
  modified_base (34)..(34): Nebularine
  modified_base (57)..(57): Nebularine

SEQ ID NO: 2053 - DNA, 100 bp, Artificial Sequence; identical to SEQ ID NO: 1946
  Description of Artificial Sequence: Synthetic oligonucleotide
  Description of Combined DNA/RNA Molecule: Synthetic oligonucleotide
  modified_base (57)..(57): Nebularine

SEQ ID NO: 2054 - DNA, 100 bp, Artificial Sequence; identical to SEQ ID NO: 1947
  Description of Artificial Sequence: Synthetic oligonucleotide
  Description of Combined DNA/RNA Molecule: Synthetic oligonucleotide
  modified_base (65)..(65): Nebularine

SEQ ID NO: 2055 - DNA, 100 bp, Artificial Sequence; identical to SEQ ID NO: 1948
  Description of Artificial Sequence: Synthetic oligonucleotide
  Description of Combined DNA/RNA Molecule: Synthetic oligonucleotide
  modified_base (34)..(34): Nebularine
  modified_base (57)..(57): Nebularine
  modified_base (65)..(65): Nebularine

SEQ ID NO: 2056 - DNA, 100 bp, Artificial Sequence; identical to SEQ ID NO: 1949
  Description of Artificial Sequence: Synthetic oligonucleotide
  Description of Combined DNA/RNA Molecule: Synthetic oligonucleotide
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2057 - RNA, 100 nt, Artificial Sequence; identical to SEQ ID NO: 1896
  Description of Artificial Sequence: Synthetic polynucleotide
  modified_base (9)..(9): Nebularine
  modified_base (14)..(14): Nebularine

SEQ ID NO: 2058 - RNA, 100 nt, Artificial Sequence; identical to SEQ ID NO: 1897
  Description of Artificial Sequence: Synthetic polynucleotide
  modified_base (9)..(9): Nebularine

SEQ ID NO: 2059 - RNA, 100 nt, Artificial Sequence; identical to SEQ ID NO: 1898
  Description of Artificial Sequence: Synthetic polynucleotide
  modified_base (14)..(14): Nebularine

SEQ ID NO: 2060 - RNA, 100 nt, Artificial Sequence; identical to SEQ ID NO: 1899
  Description of Artificial Sequence: Synthetic polynucleotide
  modified_base (34)..(34): Nebularine

SEQ ID NO: 2061 - RNA, 100 nt, Artificial Sequence; identical to SEQ ID NO: 1900
  Description of Artificial Sequence: Synthetic polynucleotide
  modified_base (34)..(34): Nebularine
  modified_base (57)..(57): Nebularine

SEQ ID NO: 2062 - RNA, 100 nt, Artificial Sequence; identical to SEQ ID NO: 1901
  Description of Artificial Sequence: Synthetic polynucleotide
  modified_base (57)..(57): Nebularine

SEQ ID NO: 2063 - RNA, 100 nt, Artificial Sequence; identical to SEQ ID NO: 1902
  Description of Artificial Sequence: Synthetic polynucleotide
  modified_base (65)..(65): Nebularine

SEQ ID NO: 2064 - RNA, 100 nt, Artificial Sequence; identical to SEQ ID NO: 1903
  Description of Artificial Sequence: Synthetic polynucleotide
  modified_base (34)..(34): Nebularine
  modified_base (57)..(57): Nebularine
  modified_base (65)..(65): Nebularine

SEQ ID NO: 2065 - RNA, 100 nt, Artificial Sequence; identical to SEQ ID NO: 1904
  Description of Artificial Sequence: Synthetic polynucleotide
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2066 - RNA, 100 nt, Artificial Sequence; identical to SEQ ID NO: 1905
  Description of Artificial Sequence: Synthetic polynucleotide
  modified_base (9)..(9): Nebularine
  modified_base (14)..(14): Nebularine
  modified_base (34)..(34): Nebularine

SEQ ID NO: 2067 - RNA, 100 nt, Artificial Sequence; identical to SEQ ID NO: 1906
  Description of Artificial Sequence: Synthetic polynucleotide
  modified_base (9)..(9): Nebularine
  modified_base (14)..(14): Nebularine
  modified_base (34)..(34): Nebularine
  modified_base (57)..(57): Nebularine

SEQ ID NO: 2068 - RNA, 100 nt, Artificial Sequence; identical to SEQ ID NO: 1907
  Description of Artificial Sequence: Synthetic polynucleotide
  modified_base (9)..(9): Nebularine
  modified_base (14)..(14): Nebularine
  modified_base (65)..(65): Nebularine

SEQ ID NO: 2069 - RNA, 100 nt, Artificial Sequence; identical to SEQ ID NO: 1908
  Description of Artificial Sequence: Synthetic polynucleotide
  modified_base (9)..(9): Nebularine
  modified_base (14)..(14): Nebularine
  modified_base (34)..(34): Nebularine
  modified_base (57)..(57): Nebularine
  modified_base (65)..(65): Nebularine

SEQ ID NO: 2070 - RNA, 100 nt, Artificial Sequence; identical to SEQ ID NO: 1909
  Description of Artificial Sequence: Synthetic polynucleotide
  modified_base (9)..(9): Nebularine
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2071 - RNA, 100 nt, Artificial Sequence; identical to SEQ ID NO: 1910
  Description of Artificial Sequence: Synthetic polynucleotide
  modified_base (9)..(9): Nebularine
  modified_base (34)..(34): Nebularine
  modified_base (57)..(57): Nebularine

SEQ ID NO: 2072 - RNA, 100 nt, Artificial Sequence; identical to SEQ ID NO: 1911
  Description of Artificial Sequence: Synthetic polynucleotide
  modified_base (9)..(9): Nebularine
  modified_base (57)..(57): Nebularine

SEQ ID NO: 2073 - RNA, 100 nt, Artificial Sequence; identical to SEQ ID NO: 1912
  Description of Artificial Sequence: Synthetic polynucleotide
  modified_base (9)..(9): Nebularine
  modified_base (65)..(65): Nebularine

SEQ ID NO: 2074 - RNA, 100 nt, Artificial Sequence; identical to SEQ ID NO: 1913
  Description of Artificial Sequence: Synthetic polynucleotide
  modified_base (9)..(9): Nebularine
  modified_base (34)..(34): Nebularine
  modified_base (57)..(57): Nebularine
  modified_base (65)..(65): Nebularine

SEQ ID NO: 2075 - RNA, 100 nt, Artificial Sequence; identical to SEQ ID NO: 1914
  Description of Artificial Sequence: Synthetic polynucleotide
  modified_base (9)..(9): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2076 - RNA, 100 nt, Artificial Sequence; identical to SEQ ID NO: 1915
  Description of Artificial Sequence: Synthetic polynucleotide
  modified_base (14)..(14): Nebularine
  modified_base (34)..(34): Nebularine

SEQ ID NO: 2077 - RNA, 100 nt, Artificial Sequence; identical to SEQ ID NO: 1916
  Description of Artificial Sequence: Synthetic polynucleotide
  modified_base (14)..(14): Nebularine
  modified_base (34)..(34): Nebularine
  modified_base (57)..(57): Nebularine

SEQ ID NO: 2078 - RNA, 100 nt, Artificial Sequence; identical to SEQ ID NO: 1917
  Description of Artificial Sequence: Synthetic polynucleotide
  modified_base (14)..(14): Nebularine
  modified_base (57)..(57): Nebularine

SEQ ID NO: 2079 - RNA, 100 nt, Artificial Sequence; identical to SEQ ID NO: 1918
  Description of Artificial Sequence: Synthetic polynucleotide
  modified_base (14)..(14): Nebularine
  modified_base (65)..(65): Nebularine

SEQ ID NO: 2080 - RNA, 100 nt, Artificial Sequence; identical to SEQ ID NO: 1919
  Description of Artificial Sequence: Synthetic polynucleotide
  modified_base (14)..(14): Nebularine
  modified_base (34)..(34): Nebularine
  modified_base (57)..(57): Nebularine
  modified_base (65)..(65): Nebularine

SEQ ID NO: 2081 - RNA, 100 nt, Artificial Sequence; identical to SEQ ID NO: 1920
  Description of Artificial Sequence: Synthetic polynucleotide
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2082 - RNA, 100 nt, Artificial Sequence; identical to SEQ ID NO: 1921
  Description of Artificial Sequence: Synthetic polynucleotide
  modified_base (9)..(9): Nebularine
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine

SEQ ID NO: 2083 - RNA, 100 nt, Artificial Sequence; identical to SEQ ID NO: 1922
  Description of Artificial Sequence: Synthetic polynucleotide
  modified_base (9)..(9): Nebularine
  modified_base (14)..(14): Nebularine
  modified_base (34)..(34): Nebularine
  modified_base (42)..(42): Nebularine
  modified_base (57)..(57): Nebularine

SEQ ID NO: 2084 - RNA, 100 nt, Artificial Sequence; identical to SEQ ID NO: 1923
  Description of Artificial Sequence: Synthetic polynucleotide
  modified_base (9)..(9): Nebularine
  modified_base (14)..(14): Nebularine
  modified_base (42)..(42): Nebularine
  modified_base (57)..(57): Nebularine

SEQ ID NO: 2085 - RNA, 100 nt, Artificial Sequence; identical to SEQ ID NO: 1924
  Description of Artificial Sequence: Synthetic polynucleotide
  modified_base (9)..(9): Nebularine
  modified_base (14)..(14): Nebularine
  modified_base (57)..(57): Nebularine

SEQ ID NO: 2086 - RNA, 100 nt, Artificial Sequence; identical to SEQ ID NO: 1925
  Description of Artificial Sequence: Synthetic polynucleotide
  modified_base (9)..(9): Nebularine
  modified_base (14)..(14): Nebularine
  modified_base (28)..(28): Nebularine

SEQ ID NO: 2087 - RNA, 100 nt, Artificial Sequence; identical to SEQ ID NO: 1927
  Description of Artificial Sequence: Synthetic polynucleotide
  modified_base (9)..(9): Nebularine
  modified_base (14)..(14): Nebularine
  modified_base (34)..(34): Nebularine
  modified_base (42)..(42): Nebularine

SEQ ID NO: 2088 - RNA, 100 nt, Artificial Sequence; identical to SEQ ID NO: 1928
  Description of Artificial Sequence: Synthetic polynucleotide
  modified_base (14)..(14): Nebularine
  modified_base (28)..(28): Nebularine
  modified_base (34)..(34): Nebularine
  modified_base (42)..(42): Nebularine
  modified_base (57)..(57): Nebularine

SEQ ID NO: 2089 - RNA, 100 nt, Artificial Sequence; identical to SEQ ID NO: 1930
  Description of Artificial Sequence: Synthetic polynucleotide
  modified_base (14)..(14): Nebularine
  modified_base (42)..(42): Nebularine
  modified_base (57)..(57): Nebularine

SEQ ID NO: 2090 - RNA, 100 nt, Artificial Sequence; identical to SEQ ID NO: 1931
  Description of Artificial Sequence: Synthetic polynucleotide
  modified_base (14)..(14): Nebularine
  modified_base (28)..(28): Nebularine

SEQ ID NO: 2091 - RNA, 100 nt, Artificial Sequence; identical to SEQ ID NO: 1932
  Description of Artificial Sequence: Synthetic polynucleotide
  modified_base (14)..(14): Nebularine
  modified_base (42)..(42): Nebularine

SEQ ID NO: 2092 - RNA, 100 nt, Artificial Sequence; identical to SEQ ID NO: 1933
  Description of Artificial Sequence: Synthetic polynucleotide
  modified_base (14)..(14): Nebularine
  modified_base (34)..(34): Nebularine
  modified_base (42)..(42): Nebularine

SEQ ID NO: 2093 - RNA, 100 nt, Artificial Sequence; identical to SEQ ID NO: 1934
  Description of Artificial Sequence: Synthetic polynucleotide
  modified_base (9)..(9): Nebularine
  modified_base (28)..(28): Nebularine
  modified_base (34)..(34): Nebularine
  modified_base (42)..(42): Nebularine
  modified_base (57)..(57): Nebularine

SEQ ID NO: 2094 - RNA, 100 nt, Artificial Sequence; identical to SEQ ID NO: 1935
  Description of Artificial Sequence: Synthetic polynucleotide
  modified_base (9)..(9): Nebularine
  modified_base (34)..(34): Nebularine
  modified_base (42)..(42): Nebularine
  modified_base (57)..(57): Nebularine

SEQ ID NO: 2095 - RNA, 100 nt, Artificial Sequence; identical to SEQ ID NO: 1936
  Description of Artificial Sequence: Synthetic polynucleotide
  modified_base (9)..(9): Nebularine
  modified_base (42)..(42): Nebularine
  modified_base (57)..(57): Nebularine

SEQ ID NO: 2096 - RNA, 100 nt, Artificial Sequence; identical to SEQ ID NO: 1937
  Description of Artificial Sequence: Synthetic polynucleotide
  modified_base (9)..(9): Nebularine
  modified_base (28)..(28): Nebularine

SEQ ID NO: 2097 - RNA, 100 nt, Artificial Sequence; identical to SEQ ID NO: 1938
  Description of Artificial Sequence: Synthetic polynucleotide
  modified_base (9)..(9): Nebularine
  modified_base (42)..(42): Nebularine

SEQ ID NO: 2098 - RNA, 100 nt, Artificial Sequence; identical to SEQ ID NO: 1939
  Description of Artificial Sequence: Synthetic polynucleotide
  modified_base (9)..(9): Nebularine
  modified_base (34)..(34): Nebularine
  modified_base (42)..(42): Nebularine

SEQ ID NO: 2099 - RNA, 100 nt, Artificial Sequence; identical to SEQ ID NO: 1940
  Description of Artificial Sequence: Synthetic polynucleotide
  modified_base (9)..(9): Nebularine
  modified_base (34)..(34): Nebularine

SEQ ID NO: 2100 - DNA, 100 bp, Artificial Sequence; identical to SEQ ID NO: 1941
  Description of Artificial Sequence: Synthetic oligonucleotide
  Description of Combined DNA/RNA Molecule: Synthetic oligonucleotide
  modified_base (9)..(9): Nebularine
  modified_base (14)..(14): Nebularine

SEQ ID NO: 2101 - DNA, 100 bp, Artificial Sequence; identical to SEQ ID NO: 1942
  Description of Artificial Sequence: Synthetic oligonucleotide
  Description of Combined DNA/RNA Molecule: Synthetic oligonucleotide
  modified_base (9)..(9): Nebularine

SEQ ID NO: 2102 - DNA, 100 bp, Artificial Sequence; identical to SEQ ID NO: 1943
  Description of Artificial Sequence: Synthetic oligonucleotide
  Description of Combined DNA/RNA Molecule: Synthetic oligonucleotide
  modified_base (14)..(14): Nebularine

SEQ ID NO: 2103 - DNA, 100 bp, Artificial Sequence; identical to SEQ ID NO: 1944
  Description of Artificial Sequence: Synthetic oligonucleotide
  Description of Combined DNA/RNA Molecule: Synthetic oligonucleotide
  modified_base (34)..(34): Nebularine

SEQ ID NO: 2104 - DNA, 100 bp, Artificial Sequence; identical to SEQ ID NO: 1945
  Description of Artificial Sequence: Synthetic oligonucleotide
  Description of Combined DNA/RNA Molecule: Synthetic oligonucleotide
  modified_base (34)..(34): Nebularine
  modified_base (57)..(57): Nebularine

SEQ ID NO: 2105 - DNA, 100 bp, Artificial Sequence; identical to SEQ ID NO: 1946
  Description of Artificial Sequence: Synthetic oligonucleotide
  Description of Combined DNA/RNA Molecule: Synthetic oligonucleotide
  modified_base (57)..(57): Nebularine

SEQ ID NO: 2106 - DNA, 100 bp, Artificial Sequence; identical to SEQ ID NO: 1947
  Description of Artificial Sequence: Synthetic oligonucleotide
  Description of Combined DNA/RNA Molecule: Synthetic oligonucleotide
  modified_base (65)..(65): Nebularine

SEQ ID NO: 2107 - DNA, 100 bp, Artificial Sequence; identical to SEQ ID NO: 1948
  Description of Artificial Sequence: Synthetic oligonucleotide
  Description of Combined DNA/RNA Molecule: Synthetic oligonucleotide
  modified_base (34)..(34): Nebularine
  modified_base (57)..(57): Nebularine
  modified_base (65)..(65): Nebularine

SEQ ID NO: 2108 - DNA, 100 bp, Artificial Sequence; identical to SEQ ID NO: 1949
  Description of Artificial Sequence: Synthetic oligonucleotide
  Description of Combined DNA/RNA Molecule: Synthetic oligonucleotide
  modified_base (28)..(28): Nebularine
  modified_base (34)..(34): Nebularine
  modified_base (42)..(42): Nebularine
  modified_base (57)..(57): Nebularine
  modified_base (65)..(65): Nebularine

SEQ ID NO: 2109 - RNA, 100 nt, Artificial Sequence
  Description of Artificial Sequence: Synthetic polynucleotide
  modified_base (98)..(100): Nubularine
cagguuccaugggaugcucuguuuuagagcuagaaauagcaaguuaaaauaaggcuaguccguuaucaacuugaaaaaguggcaccgagucggugcunnn

SEQ ID NO: 2110 - RNA, 100 nt, Artificial Sequence; identical to SEQ ID NO: 2109
  Description of Artificial Sequence: Synthetic polynucleotide
  modified_base (98)..(100): Nubularine

SEQ ID NO: 2111 - RNA, 100 nt, Artificial Sequence
  Description of Artificial Sequence: Synthetic polynucleotide
  modified_base (99)..(100): Nubularine
cagguuccaugggaugcucuguuuuagagcuagaaauagcaaguuaaaauaaggcuaguccguuaucaacuugaaaaaguggcaccgagucggugcuunn

SEQ ID NO: 2112 - RNA, 100 nt, Artificial Sequence; identical to SEQ ID NO: 2111
  Description of Artificial Sequence: Synthetic polynucleotide
  modified_base (99)..(100): Nubularine

SEQ ID NO: 2113 - RNA, 100 nt, Artificial Sequence
  Description of Artificial Sequence: Synthetic polynucleotide
  modified_base (100)..(100): Nubularine
cagguuccaugggaugcucuguuuuagagcuagaaauagcaaguuaaaauaaggcuaguccguuaucaacuugaaaaaguggcaccgagucggugcuuun

SEQ ID NO: 2114 - RNA, 100 nt, Artificial Sequence; identical to SEQ ID NO: 2113
  Description of Artificial Sequence: Synthetic polynucleotide
  modified_base (100)..(100): Nubularine

SEQ ID NO: 2115 - DNA, 100 bp, Artificial Sequence
  Description of Artificial Sequence: Synthetic oligonucleotide
  Description of Combined DNA/RNA Molecule: Synthetic oligonucleotide
  modified_base (98)..(100): Nebularine
cagguuccaugggaugcucuguuuuagagcuagaaauagcaaguuaaaauaaggcuaguccguuaucaacuugaaaaaguggcaccgagucggugcunnn

SEQ ID NO: 2116 - DNA, 100 bp, Artificial Sequence; identical to SEQ ID NO: 2115
  Description of Artificial Sequence: Synthetic oligonucleotide
  Description of Combined DNA/RNA Molecule: Synthetic oligonucleotide
  modified_base (98)..(100): Nebularine

SEQ ID NO: 2117 - DNA, 100 bp, Artificial Sequence
  Description of Artificial Sequence: Synthetic oligonucleotide
  Description of Combined DNA/RNA Molecule: Synthetic oligonucleotide
  modified_base (99)..(100): Nebularine
cagguuccaugggaugcucuguuuuagagcuagaaauagcaaguuaaaauaaggcuaguccguuaucaacuugaaaaaguggcaccgagucggugcuunn

SEQ ID NO: 2118 - DNA, 100 bp, Artificial Sequence; identical to SEQ ID NO: 2117
  Description of Artificial Sequence: Synthetic oligonucleotide
  Description of Combined DNA/RNA Molecule: Synthetic oligonucleotide
  modified_base (99)..(100): Nebularine

SEQ ID NO: 2119 - DNA, 100 bp, Artificial Sequence
  Description of Artificial Sequence: Synthetic oligonucleotide
  Description of Combined DNA/RNA Molecule: Synthetic oligonucleotide
  modified_base (100)..(100): Nebularine
cagguuccaugggaugcucuguuuuagagcuagaaauagcaaguuaaaauaaggcuaguccguuaucaacuugaaaaaguggcaccgagucggugcuuun

SEQ ID NO: 2120 - DNA, 100 bp, Artificial Sequence; identical to SEQ ID NO: 2119
  Description of Artificial Sequence: Synthetic oligonucleotide
  Description of Combined DNA/RNA Molecule: Synthetic oligonucleotide
  modified_base (100)..(100): Nebularine

SEQ ID NO: 2121 - DNA, 103 bp, Artificial Sequence
  Description of Artificial Sequence: Synthetic oligonucleotide
  Description of Combined DNA/RNA Molecule: Synthetic oligonucleotide
  modified_base (101)..(103): Nebularine
cagguuccaugggaugcucuguuuuagagcuagaaauagcaaguuaaaauaaggcuaguccguuaucaacuugaaaaaguggcaccgagucggugcuuuunnn

SEQ ID NO: 2122 - RNA, 100 nt, Artificial Sequence; identical to SEQ ID NO: 287
  Description of Artificial Sequence: Synthetic polynucleotide

SEQ ID NO: 2123 - RNA, 100 nt, Artificial Sequence
  Description of Artificial Sequence: Synthetic polynucleotide
gcaaaucuugauuuuggcucguuuuagagcuagaaauagcaaguuaaaauaaggcuaguccguuaucaacuugaaaaaguggcaccgagucggugcuuuu

SEQ ID NO: 2124 - RNA, 100 nt, Artificial Sequence
  Description of Artificial Sequence: Synthetic polynucleotide
gauguaaaaauuuuagccaaguuuuagagcuagaaauagcaaguuaaaauaaggcuaguccguuaucaacuugaaaaaguggcaccgagucggugcuuuu

SEQ ID NO: 2125 - RNA, 100 nt, Artificial Sequence
  Description of Artificial Sequence: Synthetic polynucleotide
augaaaaacuugagaguugcguuuuagagcuagaaauagcaaguuaaaauaaggcuaguccguuaucaacuugaaaaaguggcaccgagucggugcuuuu

SEQ ID NO: 2126 - RNA, 100 nt, Artificial Sequence
  Description of Artificial Sequence: Synthetic polynucleotide
acuugggaucacaaagcaaaguuuuagagcuagaaauagcaaguuaaaauaaggcuaguccguuaucaacuugaaaaaguggcaccgagucggugcuuuu

SEQ ID NO: 2127 - RNA, 100 nt, Artificial Sequence
  Description of Artificial Sequence: Synthetic polynucleotide
aagauuugguguuuucuacuguuuuagagcuagaaauagcaaguuaaaauaaggcuaguccguuaucaacuugaaaaaguggcaccgagucggugcuuuu

SEQ ID NO: 2128 - RNA, 100 nt, Artificial Sequence
  Description of Artificial Sequence: Synthetic polynucleotide
aaggaguacccggggcugcaguuuuagagcuagaaauagcaaguuaaaauaaggcuaguccguuaucaacuugaaaaaguggcaccgagucggugcuuuu

SEQ ID NO: 2129 - RNA, 100 nt, Artificial Sequence
  Description of Artificial Sequence: Synthetic polynucleotide
cagaggccaggagcgccaggguuuuagagcuagaaauagcaaguuaaaauaaggcuaguccguuaucaacuugaaaaaguggcaccgagucggugcuuuu

SEQ ID NO: 2130 - RNA, 100 nt, Artificial Sequence
  Description of Artificial Sequence: Synthetic polynucleotide
agaggccaggagcgccaggaguuuuagagcuagaaauagcaaguuaaaauaaggcuaguccguuaucaacuugaaaaaguggcaccgagucggugcuuuu

SEQ ID NO: 2131 - RNA, 100 nt, Artificial Sequence
  Description of Artificial Sequence: Synthetic polynucleotide
cucggccucugaagcuccugguuuuagagcuagaaauagcaaguuaaaauaaggcuaguccguuaucaacuugaaaaaguggcaccgagucggugcuuuu

SEQ ID NO: 2132 - DNA, 100 bp, Artificial Sequence
  Description of Artificial Sequence: Synthetic oligonucleotide
  Description of Combined DNA/RNA Molecule: Synthetic oligonucleotide
cagguuccaugggaugcucuguuuuagagcuagaaauagcaaguuaaaauaaggcuaguccguuaucaacuugaaaaaguggcaccgagucggugcuuuu

SEQ ID NO: 2133 - DNA, 100 bp, Artificial Sequence; identical to SEQ ID NO: 2132
  Description of Artificial Sequence: Synthetic oligonucleotide
  Description of Combined DNA/RNA Molecule: Synthetic oligonucleotide

SEQ ID NO: 2134 - RNA, 99 nt, Artificial Sequence
  Description of Artificial Sequence: Synthetic oligonucleotide
cagcuccaggcgguccuggguuuuagagcuagaaauagcaaguuaaaauaaggcuaguccguuaucaacuugaaaaaguggcaccgagucggugcuuuu

SEQ ID NO: 2135 - RNA, 100 nt, Artificial Sequence; identical to SEQ ID NO: 339
  Description of Artificial Sequence: Synthetic polynucleotide

SEQ ID NO: 2136 - RNA, 4929 nt, Artificial Sequence
  Description of Artificial Sequence: Synthetic polynucleotide
augagcgagguggaguucagccacgaguacuggaugcggcacgcccugacccuggccaagcgggcccgggacgagcgggaggugcccgugggcgccgugcuggugcugaacaaccgggugaucggcgagggcuggaaccgggccaucggccugcacgaccccaccgcccacgccgagaucauggcccugcggcagggcggccuggugaugcagaacuaccggcugaucgacgccacccuguacgugaccuucgagcccugcgugaugugcgccggcgccaugauccacagccggaucggccgggugguguucggcgugcggaacgccaagaccggcgccgccggcagccugauggacgugcugcaccaccccggcaugaaccaccggguggagaucaccgagggcauccuggccgacgagugcgccgcccugcugugccgguucuuccggaugccccggcggguguucaacgcccagaagaaggcccagagcagcaccgacaggaaauaagagagaaaagaagaguaagaagaaauauaagagccaccagcggcggcagcagcggcggcagcagcggcagcgagacacccggcaccagcgagagcgccacccccgagagcagcggcggcagcagcggcggcagcgacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgacgagggcgccgacaagcggaccgccgacggcagcgaguucgagagccccaagaagaagcggaaggugugagcggccgcuuaauuaagcugccuucugcggggcuugccuucuggccaugcccuucuucucucccuugcaccuguaccucuuggucuuugaauaaagccugaguaggaagucuaga

SEQ ID NO: 2137 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 2138 - RNA, 47 nt, Artificial Sequence
  Description of Artificial Sequence: Synthetic oligonucleotide
aggaaauaagagagaaaagaagaguaagaagaaauauaagagccacc

SEQ ID NO: 2139 - RNA, 501 nt, Artificial Sequence
  Description of Artificial Sequence: Synthetic polynucleotide
augagcgagguggaguucagccacgaguacuggaugcggcacgcccugacccuggccaagcgggcccgggacgagcgggaggugcccgugggcgccgugcuggugcugaacaaccgggugaucggcgagggcuggaaccgggccaucggccugcacgaccccaccgcccacgccgagaucauggcccugcggcagggcggccuggugaugcagaacuaccggcugaucgacgccacccuguacgugaccuucgagcccugcgugaugugcgccggcgccaugauccacagccggaucggccgggugguguucggcgugcggaacgccaagaccggcgccgccggcagccugauggacgugcugcaccaccccggcaugaaccaccggguggagaucaccgagggcauccuggccgacgagugcgccgcccugcugugccgguucuuccggaugccccggcggguguucaacgcccagaagaaggcccagagcagcaccgac

SEQ ID NO: 2140 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTD

SEQ ID NO: 2141 - RNA, 96 nt, Artificial Sequence
  Description of Artificial Sequence: Synthetic oligonucleotide
agcggcggcagcagcggcggcagcagcggcagcgagacacccggcaccagcgagagcgccacccccgagagcagcggcggcagcagcggcggcagc

SEQ ID NO: 2142 - RNA, 4101 nt, Artificial Sequence
  Description of Artificial Sequence: Synthetic polynucleotide
gacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgac

SEQ ID NO: 2143 - RNA, 12 nt, Artificial Sequence
  Description of Artificial Sequence: Synthetic oligonucleotide
gagggcgccgac

SEQ ID NO: 2144 - protein, 4 aa, Artificial Sequence
  Description of Artificial Sequence: Synthetic peptide
EGAD

SEQ ID NO: 2145 - RNA, 57 nt, Artificial Sequence
  Description of Artificial Sequence: Synthetic oligonucleotide
aagcggaccgccgacggcagcgaguucgagagccccaagaagaagcggaagguguga

SEQ ID NO: 2146 - protein, 18 aa, Artificial Sequence
  Description of Artificial Sequence: Synthetic peptide
KRTADGSEFESPKKKRKV

SEQ ID NO: 2147 - RNA, 115 nt, Artificial Sequence
  Description of Artificial Sequence: Synthetic polynucleotide
gcggccgcuuaauuaagcugccuucugcggggcuugccuucuggccaugcccuucuucucucccuugcaccuguaccucuuggucuuugaauaaagccugaguaggaagucuaga

SEQ ID NO: 2148 - RNA, 4929 nt, Artificial Sequence
  Description of Artificial Sequence: Synthetic polynucleotide
aggaaauaagagagaaaagaagaguaagaagaaauauaagagccaccaugagcgagguggaguucagccacgaguacuggaugcggcacgcccugacccuggccaagcgggcccgggacgagcgggaggugcccgugggcgccgugcuggugcugaacaaccgggugaucggcgagggcuggaaccgggccaucggccugcacgaccccaccgcccacgccgagaucauggcccugcggcagggcggccuggugaugcagaacuaccggcugaucgacgccacccuguacgugaccuucgagcccugcgugaugugcgccggcgccaugauccacagccggaucggccgggugguguucggcgugcggaacgccaagaccggcgccgccggcagccugauggacgugcugcaccaccccggcaugaaccaccggguggagaucaccgagggcauccuggccgacgagugcgccgcccugcugugccgguucuuccggaugccccggcggguguucaacgcccagaagaaggcccagagcagcaccgacagcggcggcagcagcggcggcagcagcggcagcgagacacccggcaccagcgagagcgccacccccgagagcagcggcggcagcagcggcggcagcgacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgagagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgacgagggcgccgacaagcggaccgccgacggcagcgaguucgagagccccaagaagaagcggaaggugugagcggccgcuuaauuaagcugccuucugcggggcuugccuucuggccaugcccuucuucucucccuugcaccuguaccucuuggucuuugaauaaagccugaguaggaagucuaga

SEQ ID NO: 2149 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 2150 - protein, 32 aa, Artificial Sequence; identical to SEQ ID NO: 20
  Description of Artificial Sequence: Synthetic polypeptide

SEQ ID NO: 2151 - RNA, 4101 nt, Artificial Sequence
  Description of Artificial Sequence: Synthetic polynucleotide
gacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgagagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgac

SEQ ID NO: 2152 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 2153 - RNA, 4929 nt, Artificial Sequence
  Description of Artificial Sequence: Synthetic polynucleotide
aggaaauaagagagaaaagaagaguaagaagaaauauaagagccaccaugagcgagguggaguucagccacgaguacuggaugcggcacgcccugacccuggccaagcgggcccgggacgagcgggaggugcccgugggcgccgugcuggugcugaacaaccgggugaucggcgagggcuggaaccgggccaucggccugcacgaccccaccgcccacgccgagaucauggcccugcggcagggcggccuggugaugcagaacuaccggcugaucgacgccacccuguacgugaccuucgagcccugcgugaugugcgccggcgccaugauccacagccggaucggccgggugguguucggcgugcggaacgccaagaccggcgccgccggcagccugauggacgugcugcaccaccccggcaugaaccaccggguggagaucaccgagggcauccuggccgacgagugcgccgcccugcugugccgguucuuccggaugccccggcggguguucaacgcccagaagaaggcccagagcagcaccgacagcggcggcagcagcggcggcagcagcggcagcgagacacccggcaccagcgagagcgccacccccgagagcagcggcggcagcagcggcggcagcgacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaacgccaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgagagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgacgagggcgccgacaagcggaccgccgacggcagcgaguucgagagccccaagaagaagcggaaggugugagcggccgcuuaauuaagcugccuucugcggggcuugccuucuggccaugcccuucuucucucccuugcaccuguaccucuuggucuuugaauaaagccugaguaggaagucuaga

SEQ ID NO: 2154 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANANFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 2155 - RNA, 4101 nt, Artificial Sequence
  Description of Artificial Sequence: Synthetic polynucleotide
gacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaacgccaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgagagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgac

SEQ ID NO: 2156 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANANFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 2157 - RNA, 4929 nt, Artificial Sequence
  Description of Artificial Sequence: Synthetic polynucleotide
aggaaauaagagagaaaagaagaguaagaagaaauauaagagccaccaugagcgagguggaguucagccacgaguacuggaugcggcacgcccugacccuggccaagcgggcccgggacgagcgggaggugcccgugggcgccgugcuggugcugaacaaccgggugaucggcgagggcuggaaccgggccaucggccugcacgaccccaccgcccacgccgagaucauggcccugcggcagggcggccuggugaugcagaacuaccggcugaucgacgccacccuguacgugaccuucgagcccugcgugaugugcgccggcgccaugauccacagccggaucggccgggugguguucggcgugcggaacgccaagaccggcgccgccggcagccugauggacgugcugcaccaccccggcaugaaccaccggguggagaucaccgagggcauccuggccgacgagugcgccgcccugcugugccgguucuuccggaugccccggcggguguucaacgcccagaagaaggcccagagcagcaccgacagcggcggcagcagcggcggcagcagcggcagcgagacacccggcaccagcgagagcgccacccccgagagcagcggcggcagcagcggcggcagcgacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaacgccaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgacgagggcgccgacaagcggaccgccgacggcagcgaguucgagagccccaagaagaagcggaaggugugagcggccgcuuaauuaagcugccuucugcggggcuugccuucuggccaugcccuucuucucucccuugcaccuguaccucuuggucuuugaauaaagccugaguaggaagucuaga

SEQ ID NO: 2158 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANANFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 2159 - RNA, 4101 nt, Artificial Sequence
  Description of Artificial Sequence: Synthetic polynucleotide
gacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaacgccaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgac

SEQ ID NO: 2160 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANANFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 2161 - RNA, 4929 nt, Artificial Sequence
  Description of Artificial Sequence: Synthetic polynucleotide
aggaaauaagagagaaaagaagaguaagaagaaauauaagagccaccauguccgaagucgaauucagccacgaguacuggaugagacaugcacugacccucgcgaagagagcucgggaugagagggaagugccagugggagcugugcuggugcucaacaacagggucauuggggaaggauggaacagggccauuggacuucacgauccgacggcucaugcggaaaucauggcacugagacagggcggucuugugaugcagaacuaucgccugauugaugccacucuguacgugaccuucgaaccuugcgugaugugcgccggugccaugauccacucacgcaucggucgggugguguucggcgugcgaaacgcuaagacuggagccgccggaucacugauggaugugcuccaucaccccgggaugaaccacaggguggagaucaccgaaggcauucuggccgacgaaugcgcagcccuguugugucgcuucuuccggaugccucgaagaguguucaacgcgcagaagaaggcgcagagcuccacugacucuggagguuccucgggcggaucgucaggguccgaaacuccuggaaccucggagucagcaacuccggaauccucaggaggcuccagcggaggcuccgauaagaaguacagcaucgggcuugccaucggaaccaacucggucggcugggcugugaucacugacgaguacaaggucccuuccaaaaaguucaaagugcucggcaacacugaucggcacucgauuaagaagaaccugaucggugcacugcuguucgacucuggggagacugcggaagcaacucgccugaagaggacugcgcgcagacgguacaccaggcgcaagaaccggaucugcuacuugcaagagauuuucagcaacgagauggccaaggucgacgacucguuuuuccaccggcucgaggaaagcuuccugguggaggaagauaagaagcaugagcgccaucccaucuucggaaacaucguggacgaaguggccuaccaugagaaguacccgaccaucuaccaucugcgcaagaagcucguggacagcacugacaaagccgacuugcgccugaucuaccuugcccuggcccacaugaucaaguucagagggcacuuccugaucgagggcgaccugaacccggacaauuccgacguggauaagcuguucauccaacugguacaaacuuacaaccagcuguuugaggagaacccgaucaacgcuuccggcguggacgcgaaggccauucugagcgcacggcuguccaagucccggagauuagaaaaccugauugcccaacugccuggagaaaagaagaauggccuguucggaaaccugaucgcccucucgcucggucugacccccaacuuuaagagcaacuucgaccuggcugaggacgcgaagcuccagcuguccaaggacaccuacgaugaugaccucgauaaucuccucgcccaaaucggcgaccaauaugcggaccuguuucuggccgccaagaaucuguccgacgccauccuccugagcgauauccugcgcgugaacacugaaaucaccaaggccccacugagcgcuagcaugauuaagcgcuacgacgaacaccaucaggaccucacccugcugaaggcucuugugcggcagcagcucccagagaaguacaaggagaucuucuucgaccaaucgaagaaugguuacgccggcuacauugacggaggagcgucacaggaggaguucuacaaguucauuaagccaauccuggagaagauggacggaaccgaggaacugcucgugaagcugaacagagaagaucuacugcgcaagcagcgcacuuucgacaacggaucgaucccacaucagauucaccugggagagcugcacgcgauccugcggagacaggaagauuucuacccguuccugaaggacaaccgcgagaagaucgaaaagauccugaccuuccgcauuccguacuacgugggaccccucgcaagaggaaacucgcgguucgccuggaugaccaggaagucggaagaaaccauuacuccguggaacuucgaggaagugguggacaagggcgccucagcgcaauccuucaucgaacggaugaccaacuucgacaagaacuugccuaacgagaaagugcuuccuaagcauucccuccuuuacgaauacuucacuguguacaacgagcuuaccaaggucaaauaugugaccgagggcaugcgcaagccggccuuucuuuccggggagcaaaagaaggccaucguggaccuguuguucaagaccaaccggaaggucaccgucaagcagcugaaggaggacuacuuuaagaaaaucgagugcuuugauuccgucgaaaucuccggaguggaagauagauucaacgccagccuaggcaccuaccacgaucugcucaagaucauuaaggauaaggauuuccuggacaacgaggagaacgaggauauccuggaggacauugugcugacccugacacuguucgaagaucgcgaaaugaucgaggagcggcugaaaacauacgcccaccuguucgacgacaaggucaugaagcagcucaagcggaggagguacacgggauggggaaggcugucccggaagcugaucaacgggauuagagacaagcaguccggaaagaccauucuggacuuccucaagucggacggcuucgcgaaccggaacuucaugcaacugauccacgacgacucccugacguucaaggaggacauucagaaggcccaaguguccggacagggagauucacugcacgaacacaucgccaaucuggcuggaaguccggccaucaagaaaggcauccugcaaaccgugaaggucguggacgagcucgugaaggucaugggccgccacaagccugagaacaucgugaucgaaauggcccgggagaaccagaccacgcagaaagggcagaagaacagccgcgagaggaugaagagaaucgaggaaggaaucaaggaacuuggaagccagauccugaaggaacaccccguggaaaacacucagcuucaaaacgaaaagcuguaccucuacuaucugcaaaacggacgggauauguacguggaccaggaauuggacaucaaucgccuguccgacuacgauguggaucacauugugccgcagagcuuucugaaggacgauucaauugauaacaaggugcucacccgguccgacaagaaccggggcaaaagcgauaacgugccgagcgaagagguggucaagaagaugaagaauuacuggcggcagcucuugaacgccaaacugaucacccagcggaaguucgacaaccugaccaaggccgaaaggggcggucuuuccgaacuggacaaggccggguuuaucaagcgccaacugguggaaacccggcagaucacuaagcacguggcccagauacuggacucuaggaugaauaccaaauacgacgagaacgacaagcugauucgcgaagucaaagucauuacccugaaauccaagcucguguccgacuuccggaaggacuuccaguucuauaagguucgcgaaaucaacaacuaccaccacgcccaugacgcguaccugaacgccgucguggguaccgcccugauuaagaaguacccuaagcucgaguccgaguucgucuacggagacuacaaaguguacgacgugcggaagaugaucgccaaguccgagcaggaaauagggaaggccaccgccaaguacuucuucuacuccaacaucaugaacuucuucaagaccgagaucacccuugccaacggggagauucggaagcgcccguugauugagacuaacggagaaaccggcgaaauugugugggauaagggcagagacuuugcgacugugcgcaaagucuugucaaugccccaagucaacauugucaaaaagaccgaagugcaaaccggcggcuucagcaaggaaagcauccugcccaagcgcaauuccgacaagcucaucgcccggaagaaggacugggaccccaagaaauauggaggcuucgacucccccacuguggccuacuccguccugguggucgcgaaaguggaaaagggaaagucgaagaagcucaaguccgugaaggagcuccuggggaucaccauuauggaacgguccagcuucgagaagaacccgauugacuuccuggaagccaaggguuacaaggaggucaagaaggaucugauuauuaagcugccgaaguauucccucuucgaacucgaaaauggccgcaagcgaauguuggcaucggcgggagagcuccagaagggaaacgaacuggccuugccuuccaaauacgugaacuuucuguaccuggccagccacuacgagaagcugaaggguucccccgaggacaacgagcagaagcagcuguucguggagcagcacaagcacuaccuggaugagaucaucgaacagaucucggaauucuccaagagagugauccuggccgacgcgaaccuggauaagguccuguccgcguacaacaagcaccgggacaagcccauccgggagcaggcugagaacauuauccaccuguucacccucacuaaccuuggagcgccugccgcauucaaguacuucgacacaaccaucgacagaaagcgcuacacuuccaccaaggaggugcuggacgccacccugauccaccaguccaucacugggcucuaugagacucgcauugaccugucccaguugggaggggacgaaggagccgauaagagaaccgccgauggguccgaauucgagucgcccaagaagaagcggaaaguguaagcggccgcuuaauuaagcugccuucugcggggcuugccuucuggccaugcccuucuucucucccuugcaccuguaccucuuggucuuugaauaaagccugaguaggaagucuaga

SEQ ID NO: 2162 - RNA, 501 nt, Artificial Sequence
  Description of Artificial Sequence: Synthetic polynucleotide
auguccgaagucgaauucagccacgaguacuggaugagacaugcacugacccucgcgaagagagcucgggaugagagggaagugccagugggagcugugcuggugcucaacaacagggucauuggggaaggauggaacagggccauuggacuucacgauccgacggcucaugcggaaaucauggcacugagacagggcggucuugugaugcagaacuaucgccugauugaugccacucuguacgugaccuucgaaccuugcgugaugugcgccggugccaugauccacucacgcaucggucgggugguguucggcgugcgaaacgcuaagacuggagccgccggaucacugauggaugugcuccaucaccccgggaugaaccacaggguggagaucaccgaaggcauucuggccgacgaaugcgcagcccuguugugucgcuucuuccggaugccucgaagaguguucaacgcgcagaagaaggcgcagagcuccacugac

SEQ ID NO: 2163 - RNA, 96 nt, Artificial Sequence
  Description of Artificial Sequence: Synthetic oligonucleotide
ucuggagguuccucgggcggaucgucaggguccgaaacuccuggaaccucggagucagcaacuccggaauccucaggaggcuccagcggaggcucc

SEQ ID NO: 2164 - RNA, 4101 nt, Artificial Sequence
  Description of Artificial Sequence: Synthetic polynucleotide
gauaagaaguacagcaucgggcuugccaucggaaccaacucggucggcugggcugugaucacugacgaguacaaggucccuuccaaaaaguucaaagugcucggcaacacugaucggcacucgauuaagaagaaccugaucggugcacugcuguucgacucuggggagacugcggaagcaacucgccugaagaggacugcgcgcagacgguacaccaggcgcaagaaccggaucugcuacuugcaagagauuuucagcaacgagauggccaaggucgacgacucguuuuuccaccggcucgaggaaagcuuccugguggaggaagauaagaagcaugagcgccaucccaucuucggaaacaucguggacgaaguggccuaccaugagaaguacccgaccaucuaccaucugcgcaagaagcucguggacagcacugacaaagccgacuugcgccugaucuaccuugcccuggcccacaugaucaaguucagagggcacuuccugaucgagggcgaccugaacccggacaauuccgacguggauaagcuguucauccaacugguacaaacuuacaaccagcuguuugaggagaacccgaucaacgcuuccggcguggacgcgaaggccauucugagcgcacggcuguccaagucccggagauuagaaaaccugauugcccaacugccuggagaaaagaagaauggccuguucggaaaccugaucgcccucucgcucggucugacccccaacuuuaagagcaacuucgaccuggcugaggacgcgaagcuccagcuguccaaggacaccuacgaugaugaccucgauaaucuccucgcccaaaucggcgaccaauaugcggaccuguuucuggccgccaagaaucuguccgacgccauccuccugagcgauauccugcgcgugaacacugaaaucaccaaggccccacugagcgcuagcaugauuaagcgcuacgacgaacaccaucaggaccucacccugcugaaggcucuugugcggcagcagcucccagagaaguacaaggagaucuucuucgaccaaucgaagaaugguuacgccggcuacauugacggaggagcgucacaggaggaguucuacaaguucauuaagccaauccuggagaagauggacggaaccgaggaacugcucgugaagcugaacagagaagaucuacugcgcaagcagcgcacuuucgacaacggaucgaucccacaucagauucaccugggagagcugcacgcgauccugcggagacaggaagauuucuacccguuccugaaggacaaccgcgagaagaucgaaaagauccugaccuuccgcauuccguacuacgugggaccccucgcaagaggaaacucgcgguucgccuggaugaccaggaagucggaagaaaccauuacuccguggaacuucgaggaagugguggacaagggcgccucagcgcaauccuucaucgaacggaugaccaacuucgacaagaacuugccuaacgagaaagugcuuccuaagcauucccuccuuuacgaauacuucacuguguacaacgagcuuaccaaggucaaauaugugaccgagggcaugcgcaagccggccuuucuuuccggggagcaaaagaaggccaucguggaccuguuguucaagaccaaccggaaggucaccgucaagcagcugaaggaggacuacuuuaagaaaaucgagugcuuugauuccgucgaaaucuccggaguggaagauagauucaacgccagccuaggcaccuaccacgaucugcucaagaucauuaaggauaaggauuuccuggacaacgaggagaacgaggauauccuggaggacauugugcugacccugacacuguucgaagaucgcgaaaugaucgaggagcggcugaaaacauacgcccaccuguucgacgacaaggucaugaagcagcucaagcggaggagguacacgggauggggaaggcugucccggaagcugaucaacgggauuagagacaagcaguccggaaagaccauucuggacuuccucaagucggacggcuucgcgaaccggaacuucaugcaacugauccacgacgacucccugacguucaaggaggacauucagaaggcccaaguguccggacagggagauucacugcacgaacacaucgccaaucuggcuggaaguccggccaucaagaaaggcauccugcaaaccgugaaggucguggacgagcucgugaaggucaugggccgccacaagccugagaacaucgugaucgaaauggcccgggagaaccagaccacgcagaaagggcagaagaacagccgcgagaggaugaagagaaucgaggaaggaaucaaggaacuuggaagccagauccugaaggaacaccccguggaaaacacucagcuucaaaacgaaaagcuguaccucuacuaucugcaaaacggacgggauauguacguggaccaggaauuggacaucaaucgccuguccgacuacgauguggaucacauugugccgcagagcuuucugaaggacgauucaauugauaacaaggugcucacccgguccgacaagaaccggggcaaaagcgauaacgugccgagcgaagagguggucaagaagaugaagaauuacuggcggcagcucuugaacgccaaacugaucacccagcggaaguucgacaaccugaccaaggccgaaaggggcggucuuuccgaacuggacaaggccggguuuaucaagcgccaacugguggaaacccggcagaucacuaagcacguggcccagauacuggacucuaggaugaauaccaaauacgacgagaacgacaagcugauucgcgaagucaaagucauuacccugaaauccaagcucguguccgacuuccggaaggacuuccaguucuauaagguucgcgaaaucaacaacuaccaccacgcccaugacgcguaccugaacgccgucguggguaccgcccugauuaagaaguacccuaagcucgaguccgaguucgucuacggagacuacaaaguguacgacgugcggaagaugaucgccaaguccgagcaggaaauagggaaggccaccgccaaguacuucuucuacuccaacaucaugaacuucuucaagaccgagaucacccuugccaacggggagauucggaagcgcccguugauugagacuaacggagaaaccggcgaaauugugugggauaagggcagagacuuugcgacugugcgcaaagucuugucaaugccccaagucaacauugucaaaaagaccgaagugcaaaccggcggcuucagcaaggaaagcauccugcccaagcgcaauuccgacaagcucaucgcccggaagaaggacugggaccccaagaaauauggaggcuucgacucccccacuguggccuacuccguccugguggucgcgaaaguggaaaagggaaagucgaagaagcucaaguccgugaaggagcuccuggggaucaccauuauggaacgguccagcuucgagaagaacccgauugacuuccuggaagccaaggguuacaaggaggucaagaaggaucugauuauuaagcugccgaaguauucccucuucgaacucgaaaauggccgcaagcgaauguuggcaucggcgggagagcuccagaagggaaacgaacuggccuugccuuccaaauacgugaacuuucuguaccuggccagccacuacgagaagcugaaggguucccccgaggacaacgagcagaagcagcuguucguggagcagcacaagcacuaccuggaugagaucaucgaacagaucucggaauucuccaagagagugauccuggccgacgcgaaccuggauaagguccuguccgcguacaacaagcaccgggacaagcccauccgggagcaggcugagaacauuauccaccuguucacccucacuaaccuuggagcgccugccgcauucaaguacuucgacacaaccaucgacagaaagcgcuacacuuccaccaaggaggugcuggacgccacccugauccaccaguccaucacugggcucuaugagacucgcauugaccugucccaguugggaggggac

SEQ ID NO: 2165 - protein, 1367 aa, Artificial Sequence; identical to SEQ ID NO: 40
  Description of Artificial Sequence: Synthetic polypeptide

SEQ ID NO: 2166 - RNA, 12 nt, Artificial Sequence
  Description of Artificial Sequence: Synthetic oligonucleotide
gaaggagccgau

SEQ ID NO: 2167 - RNA, 57 nt, Artificial Sequence
  Description of Artificial Sequence: Synthetic oligonucleotide
aagagaaccgccgauggguccgaauucgagucgcccaagaagaagcggaaaguguaa

SEQ ID NO: 2168 - RNA, 4929 nt, Artificial Sequence
  Description of Artificial Sequence: Synthetic polynucleotide
aggaaauaagagagaaaagaagaguaagaagaaauauaagagccaccaugucagaaguagaauucucccacgaguauuggaugagacacgcucucacacucgccaagcgagcuagggaugaaagggaaguaccagugggggccguacugguacucaacaauagggucauaggagagggguggaaucgagcaauugggcugcaugaucccacugcacacgcggagauuauggcucuuagacaagggggccuggugaugcagaauuaccgccucauugacgcaacccuuuacgugacauuugagccaugcguuaugugcgcgggcgcaaugauacacucuaggauaggccgcguaguuuucggaguccgaaaugcgaagacuggggcggccggaucucugauggacgugcuccaccauccaggcaugaaccaccgaguggagauaacggaaggcaucuuggcggacgaaugugcugcgcuccuuugcagguucuuccggaugccaagacggguauucaacgcgcagaagaaggcacagucaagcacugauaguggcggcaguuccggaggaucuaguggguccgaaacgccagggaccuccgaauccgcaacucccgaaaguucaggaggcuccuccggcggcagcgacaagaaguacuccauuggucuggcgaucgguacgaauaguguugggugggcuguaauaacugacgaguauaaggugcccaguaagaaguucaaaguccuggggaacacagaccgacauagcaucaagaagaaccugauaggugcgcucuuguuugacuccggagagacagcagaagccacacgacuuaaacgaaccgcucgaaggcgguacacacggcgaaagaauaggauuuguuaccugcaggagauauuuagcaacgagauggcaaagguugacgauuccuucuuccaccggcuugaagagucuuuccugguggaggaggacaagaaacaugaacgccaccccauauuuggcaauauaguggacgaaguagcauaccaugagaaauacccuaccauauaucaucuucgaaagaagcuuguagauucaacggauaaagcagaucucagguugauauaucuggcacuggcacacaugaucaaguuucgaggucacuuucuuaucgagggcgaucuuaauccggacaacuccgacguggauaagcuguucauccagcucguccaaacguauaaccaacucuucgaggagaauccgaucaaugccucuggaguggacgcgaaagcgauacucucagcaaggcuuaguaagucucgccggcuugagaaccucaucgcacaguugccaggagagaagaagaauggcuuguuugguaaccuuauugcacucagucucggccuuacaccuaacuucaaguccaacuucgaucuugccgaggacgccaagcuccagcuuagcaaggauaccuacgaugacgaucuugauaaccugcuggcccagauaggcgaccaguacgcggaccuuuucuuggcagcaaagaauuuguccgacgccauccucuugagcgacauccuccggguaaacacugaaauuacuaaggcgccacuuuccgccagcaugaucaagagauacgaugagcaucaucaggaucugacccugcuuaaagcgcuuguacgccagcaauugccugagaaguauaaagaaaucuuuuucgaccaaagcaagaacgguuaugcuggcuacauagacggcggggcuucucaggaggaauucuacaaguuuaucaagccgauucucgagaagauggauggaacagaggagcuguuggugaaacugaaccgggaggaccugcucagaaagcagcggaccuucgauaaugggagcaucccgcaccagauucauuugggugagcugcaugcaaucuugcgcaggcaagaagauuuuuaccccuuccucaaggacaauagagagaagauugagaagauccuuacguuuaggauuccguauuacguaggcccgcucgcacgcgguaauucucgcuuugcguggaugacacgaaagagcgaggaaaccauaacacccuggaacuuugaagaggucgucgauaagggugccagcgcacaaucauuuaucgaacgaaugacuaauuucgauaagaaucucccaaaugagaagguguugccaaagcauagccuuuuguaugaguauuuuacuguauacaacgagcucaccaaggugaaauaugucacugaagggaugcgcaagccggccuuuuugagcggagaacagaagaaagcuauuguagacuugcuuuuuaagacgaauagaaagguuacggucaagcagcucaaagaagacuacuuuaagaagauagaaugcuuugacucugucgagauuagugggguagaggaucgauucaaugcaagccuggggacauaccacgaucucuugaagauuaucaaggauaaggauuuucuggacaacgaagagaaugaagacaucuuggaagauauuguuuugacuuugacucuuuucgaagaucgcgagaugauagaggaaagguugaagacuuaugcccaucuuuuugaugacaagguuaugaaacaacugaagagacggcgauauacugguugggggagacucucacgaaagcucauuaacggcauccgggacaaacagagugguaagacgauuuuggacuuccuuaagagcgacggguuugcgaauaggaacuucaugcaguugauccaugaugauucuuugaccuuuaaggaggauauacagaaggcacaagucaguggacaaggagauagucugcaugagcacauugccaaccuugcgggcuccccagccaucaagaaggguauccugcaaaccgucaaaguaguagaugaacuugugaaagucaugggacgacauaagccugagaauauugugaucgaaauggcuagggagaaucagacgacucagaagggucagaagaauuccagggaacggaugaagagaauagaggagggaauuaaggaacucgggucacaaauauugaaggagcauccuguagagaacacacagcuucagaacgagaagcuguaccuguauuaucuccagaauggcagagacauguaugucgaccaagaacuggauaucaaucgcuuguccgauuaugauguagaucacauagucccacaauccuucuugaaagacgauaguauugacaauaagguacuuacgagauccgacaagaaccgcggaaaguccgauaacguaccgagugaagaagugguaaagaagaugaagaauuauuggaggcagcuccucaacgccaaacuuauuacucagagaaaguucgauaaccuuacgaaagcugagcgaggcggguugucugagcucgauaaagcuggauucauaaagcggcagcuuguggaaacuagacagaucacaaagcacguugcacagauccuugauuccagaaugaacacuaaauaugaugagaacgauaagcugauacgcgaggugaaaguaauaacacuuaagucaaagcugguaagcgauuuucgcaaagacuuccaauuuuauaaggucagagagauaaacaauuaucaucacgcgcaugacgcuuaccugaacgcaguuguggggacagcacuuauaaagaaauacccaaaguuggaaagugaauuugucuauggagacuauaagguauacgauguacggaagaugauugcgaagucagagcaagaaaucgguaaggcaacugcuaaguacuucuuuuacucaaauauuaugaacuuuuucaagacggaaaucacucuggcuaacggagaaauucggaagaggcccuugauagagacgaauggggagacuggugagaucguuugggacaaagggcgagauuucgcaacgguccgaaaggugcucucaaugccacaagucaauauagucaagaagacagagguacaaacaggagguuucuccaaggaaucaauacucccaaagcggaauuccgacaaacugauagcuagaaagaaggacugggauccgaagaaguauggaggguuugauuccccaacaguagcguauucaguacuggugguagcuaagguggagaaaggcaagucuaagaagcuuaagucugucaaagagcugcucggcaucaccauuauggagcgcaguagcuucgagaagaacccuauagauuuucuggaagccaaaggauauaaggagguuaagaaggaucucaucaucaaacucccgaaguauagucuuuuugaguuggagaacggacgaaagcgcaugcuugcgucugcgggugaauugcagaaaggaaaugagcucgccuugccgucaaaguaugucaauuucuuguaccuugcgagucacuaugagaagcugaaaggaagcccagaagauaaugaacagaagcaauuguucguugaacaacauaagcauuauuuggacgagaucaucgagcaaaucagcgaguucagcaagcgcgucauacuugcggacgccaaucuggacaaagugcuguccgccuauaacaaacauagggacaaaccuauacgagagcaggcagagaauauaauacaucucuucacacuuacuaaucuuggagcuccagccgcauucaaguauuuugacacgacuauagaucgcaagcgauauaccucuacgaaagaaguucuggacgcuacucuuauacaucaauccauuacgggccuguacgagacgaggauugacuugucacagcuugguggugacgagggugcagacaagcgaacagcggacgggucagaauucgaaagccccaagaagaagcggaaaguuuaagcggccgcuuaauuaagcugccuucugcggggcuugccuucuggccaugcccuucuucucucccuugcaccuguaccucuuggucuuugaauaaagccugaguaggaagucuaga

SEQ ID NO: 2169 - RNA, 501 nt, Artificial Sequence
  Description of Artificial Sequence: Synthetic polynucleotide
augucagaaguagaauucucccacgaguauuggaugagacacgcucucacacucgccaagcgagcuagggaugaaagggaaguaccagugggggccguacugguacucaacaauagggucauaggagagggguggaaucgagcaauugggcugcaugaucccacugcacacgcggagauuauggcucuuagacaagggggccuggugaugcagaauuaccgccucauugacgcaacccuuuacgugacauuugagccaugcguuaugugcgcgggcgcaaugauacacucuaggauaggccgcguaguuuucggaguccgaaaugcgaagacuggggcggccggaucucugauggacgugcuccaccauccaggcaugaaccaccgaguggagauaacggaaggcaucuuggcggacgaaugugcugcgcuccuuugcagguucuuccggaugccaagacggguauucaacgcgcagaagaaggcacagucaagcacugau

SEQ ID NO: 2170 - RNA, 96 nt, Artificial Sequence
  Description of Artificial Sequence: Synthetic oligonucleotide
aguggcggcaguuccggaggaucuaguggguccgaaacgccagggaccuccgaauccgcaacucccgaaaguucaggaggcuccuccggcggcagc

SEQ ID NO: 2171 - RNA, 4101 nt, Artificial Sequence
  Description of Artificial Sequence: Synthetic polynucleotide
gacaagaaguacuccauuggucuggcgaucgguacgaauaguguugggugggcuguaauaacugacgaguauaaggugcccaguaagaaguucaaaguccuggggaacacagaccgacauagcaucaagaagaaccugauaggugcgcucuuguuugacuccggagagacagcagaagccacacgacuuaaacgaaccgcucgaaggcgguacacacggcgaaagaauaggauuuguuaccugcaggagauauuuagcaacgagauggcaaagguugacgauuccuucuuccaccggcuugaagagucuuuccugguggaggaggacaagaaacaugaacgccaccccauauuuggcaauauaguggacgaaguagcauaccaugagaaauacccuaccauauaucaucuucgaaagaagcuuguagauucaacggauaaagcagaucucagguugauauaucuggcacuggcacacaugaucaaguuucgaggucacuuucuuaucgagggcgaucuuaauccggacaacuccgacguggauaagcuguucauccagcucguccaaacguauaaccaacucuucgaggagaauccgaucaaugccucuggaguggacgcgaaagcgauacucucagcaaggcuuaguaagucucgccggcuugagaaccucaucgcacaguugccaggagagaagaagaauggcuuguuugguaaccuuauugcacucagucucggccuuacaccuaacuucaaguccaacuucgaucuugccgaggacgccaagcuccagcuuagcaaggauaccuacgaugacgaucuugauaaccugcuggcccagauaggcgaccaguacgcggaccuuuucuuggcagcaaagaauuuguccgacgccauccucuugagcgacauccuccggguaaacacugaaauuacuaaggcgccacuuuccgccagcaugaucaagagauacgaugagcaucaucaggaucugacccugcuuaaagcgcuuguacgccagcaauugccugagaaguauaaagaaaucuuuuucgaccaaagcaagaacgguuaugcuggcuacauagacggcggggcuucucaggaggaauucuacaaguuuaucaagccgauucucgagaagauggauggaacagaggagcuguuggugaaacugaaccgggaggaccugcucagaaagcagcggaccuucgauaaugggagcaucccgcaccagauucauuugggugagcugcaugcaaucuugcgcaggcaagaagauuuuuaccccuuccucaaggacaauagagagaagauugagaagauccuuacguuuaggauuccguauuacguaggcccgcucgcacgcgguaauucucgcuuugcguggaugacacgaaagagcgaggaaaccauaacacccuggaacuuugaagaggucgucgauaagggugccagcgcacaaucauuuaucgaacgaaugacuaauuucgauaagaaucucccaaaugagaagguguugccaaagcauagccuuuuguaugaguauuuuacuguauacaacgagcucaccaaggugaaauaugucacugaagggaugcgcaagccggccuuuuugagcggagaacagaagaaagcuauuguagacuugcuuuuuaagacgaauagaaagguuacggucaagcagcucaaagaagacuacuuuaagaagauagaaugcuuugacucugucgagauuagugggguagaggaucgauucaaugcaagccuggggacauaccacgaucucuugaagauuaucaaggauaaggauuuucuggacaacgaagagaaugaagacaucuuggaagauauuguuuugacuuugacucuuuucgaagaucgcgagaugauagaggaaagguugaagacuuaugcccaucuuuuugaugacaagguuaugaaacaacugaagagacggcgauauacugguugggggagacucucacgaaagcucauuaacggcauccgggacaaacagagugguaagacgauuuuggacuuccuuaagagcgacggguuugcgaauaggaacuucaugcaguugauccaugaugauucuuugaccuuuaaggaggauauacagaaggcacaagucaguggacaaggagauagucugcaugagcacauugccaaccuugcgggcuccccagccaucaagaaggguauccugcaaaccgucaaaguaguagaugaacuugugaaagucaugggacgacauaagccugagaauauugugaucgaaauggcuagggagaaucagacgacucagaagggucagaagaauuccagggaacggaugaagagaauagaggagggaauuaaggaacucgggucacaaauauugaaggagcauccuguagagaacacacagcuucagaacgagaagcuguaccuguauuaucuccagaauggcagagacauguaugucgaccaagaacuggauaucaaucgcuuguccgauuaugauguagaucacauagucccacaauccuucuugaaagacgauaguauugacaauaagguacuuacgagauccgacaagaaccgcggaaaguccgauaacguaccgagugaagaagugguaaagaagaugaagaauuauuggaggcagcuccucaacgccaaacuuauuacucagagaaaguucgauaaccuuacgaaagcugagcgaggcggguugucugagcucgauaaagcuggauucauaaagcggcagcuuguggaaacuagacagaucacaaagcacguugcacagauccuugauuccagaaugaacacuaaauaugaugagaacgauaagcugauacgcgaggugaaaguaauaacacuuaagucaaagcugguaagcgauuuucgcaaagacuuccaauuuuauaaggucagagagauaaacaauuaucaucacgcgcaugacgcuuaccugaacgcaguuguggggacagcacuuauaaagaaauacccaaaguuggaaagugaauuugucuauggagacuauaagguauacgauguacggaagaugauugcgaagucagagcaagaaaucgguaaggcaacugcuaaguacuucuuuuacucaaauauuaugaacuuuuucaagacggaaaucacucuggcuaacggagaaauucggaagaggcccuugauagagacgaauggggagacuggugagaucguuugggacaaagggcgagauuucgcaacgguccgaaaggugcucucaaugccacaagucaauauagucaagaagacagagguacaaacaggagguuucuccaaggaaucaauacucccaaagcggaauuccgacaaacugauagcuagaaagaaggacugggauccgaagaaguauggaggguuugauuccccaacaguagcguauucaguacuggugguagcuaagguggagaaaggcaagucuaagaagcuuaagucugucaaagagcugcucggcaucaccauuauggagcgcaguagcuucgagaagaacccuauagauuuucuggaagccaaaggauauaaggagguuaagaaggaucucaucaucaaacucccgaaguauagucuuuuugaguuggagaacggacgaaagcgcaugcuugcgucugcgggugaauugcagaaaggaaaugagcucgccuugccgucaaaguaugucaauuucuuguaccuugcgagucacuaugagaagcugaaaggaagcccagaagauaaugaacagaagcaauuguucguugaacaacauaagcauuauuuggacgagaucaucgagcaaaucagcgaguucagcaagcgcgucauacuugcggacgccaaucuggacaaagugcuguccgccuauaacaaacauagggacaaaccuauacgagagcaggcagagaauauaauacaucucuucacacuuacuaaucuuggagcuccagccgcauucaaguauuuugacacgacuauagaucgcaagcgauauaccucuacgaaagaaguucuggacgcuacucuuauacaucaauccauuacgggccuguacgagacgaggauugacuugucacagcuugguggugac

SEQ ID NO: 2172 - RNA, 12 nt, Artificial Sequence
  Description of Artificial Sequence: Synthetic oligonucleotide
gagggugcagac

SEQ ID NO: 2173 - RNA, 57 nt, Artificial Sequence
  Description of Artificial Sequence: Synthetic oligonucleotide
aagcgaacagcggacgggucagaauucgaaagccccaagaagaagcggaaaguuuaa

SEQ ID NO: 2174 - RNA, 4929 nt, Artificial Sequence
  Description of Artificial Sequence: Synthetic polynucleotide
aggaaauaagagagaaaagaagaguaagaagaaauauaagagccaccaugucugagguggaguucucccacgaguacuggaugcggcaugcucugacuuuggccaagagagcccgagaugagcgggaggucccugugggcgcagugcuggugcugaacaacagggugaucggcgagggcuggaaccgggccaucggccugcacgacccuacagcucacgccgagaucauggcccuuagacagggcggccuggugaugcagaacuacagacugaucgacgccacacuguacgucaccuuugagccuugcgugaugugcgccggagccaugauccauagccggauaggacggguggucuuuggcgugcggaacgcgaagaccggcgccgccggcagccuuauggaugugcugcaccauccuggcaugaaccacaggguggagaucaccgaaggcauccuggcugaugaaugugccgcucugcugugcagauucuuucggaugccuagaagaguguucaacgcccagaagaaagcccagaguagcaccgauagcggcggcagcagcggcggcagcagcggaagcgagacaccuggcaccagcgaauccgccacaccugagagcucuggaggaagcucaggcggcucugacaagaaauacucaaucggacuggccaucggcaccaauagcgugggcugggccgugaucacagaugaauauaaggugccuagcaagaaguucaaggugcugggcaacaccgauagacacagcaucaagaagaaccugaucggagcccugcuguucgacagcggcgaaaccgccgaagccaccagacugaagagaaccgccagaagacgguacacccggcguaagaacaggaucuguuaccugcaggagaucuucagcaacgaaauggccaagguggacgacucuuucuuccacagacuggaggagagcuuucugguggaagaagacaagaagcaugagcggcaccccaucuuuggcaacaucguggacgaaguggccuaccacgagaaauacccaacaaucuaucaccugagaaagaagcugguggacagcaccgauaaggccgaccugcggcugaucuaccuggcccuggcacacaugaucaaguucagaggccacuuccugaucgagggcgaccugaaccccgauaauagcgauguggauaagcuguucauccagcuggugcagaccuacaaccagcuguucgaggagaacccgaucaacgccucgggaguugaugccaaggcaauccugucugcuagacugaguaagagcagaagacuggagaaccugaucgcccagcugcccggagagaagaagaaugggcuguuuggcaaccugauugcccugucucugggccuuacaccuaacuucaagagcaacuuugaccuggccgaagacgccaagcugcaacugucuaaggauaccuacgacgacgaucuggacaaccugcuggcccaaaucggggaucaauacgccgaccuguuccuggcugccaagaaucugucugacgccauccuucuguccgauauccugcgggugaacacagagauaaccaaagcuccucuuagugcgagcaugaucaagagauaugaugagcaccaccaagaucugacgcuccugaaggcccuggucagacagcagcucccugagaaauacaaggaaauuuucuucgaccagagcaagaauggcuacgccggcuacaucgauggcggcgccagccaggaggaauuuuacaaguuuaucaaaccaauccucgagaagauggacggcaccgaggaacugcucgugaagcugaacagagaggaccuacugcggaagcagcggacguucgacaacggcagcaucccucaccagauccaccugggugagcugcacgcaauccugagaagacaggaagauuucuaccccuuccugaaagacaaccgggagaagaucgagaagauccugacauuuagaauucccuacuacgugggcccucuggcuagaggcaacucccgguucgccuggaugacccggaaguccgaagaaaccaucacccccuggaacuuugaggagguaguggacaagggcgccagcgcucagagcuuuauagagagaaugaccaacuucgacaagaaucugccaaacgagaaaguccugccuaagcacucucugcuguaugaguacuucaccguuuacaacgagcugacaaaggugaaauacgugacggaggggaugaggaagcccgccuuccugagcggcgaacagaagaaggcuaucguugaccugcuguucaagaccaauaggaaggugaccgugaagcagcucaaggaggacuacuucaagaagauugagugcuucgacucuguggaaaucucuggaguugaggaccgguucaacgcaucccugggaacauaccacgaucugcugaagaucauuaaggacaaggacuuucuggacaaugaggagaacgaagauauccuggaggacauugugcugacccugacacuguuugaagaucgugaaaugaucgaagaacggcugaagacauacgcccaucuguucgacgacaagguuaugaagcagcugaagagaagaagauauacaggguggggcaggcuguccaggaaacugaucaacggcauccgggacaagcagagcggcaagacaauucuggacuuccucaagagcgacggcuucgccaacagaaauuuuaugcagcugauccaugacgauagccugacauucaaggaagacauccagaaggcccaggugagcgggcaaggcgacagccugcacgagcacaucgccaaccuggccggcucucccgcuaucaagaagggaauccugcagacagugaaggugguugaugaguuagugaaagugaugggccggcacaagccugagaauaucgugauugaaauggccagagagaaccagacaacucagaagggccagaagaacucccgagagagaaugaagagaaucgaagagggaaucaaagagcuaggcagccaaauccucaaagaacaccccguggagaauacccagcugcagaacgagaagcuguaccuguacuaccugcagaacggccgagauauguacguggaucaggagcuggacaucaauaggcugucagacuacgacguggaccacaucgugccucagagcuuucugaaggaugauucuaucgacaacaagguguuaaccagauccgacaagaacagaggcaagagcgauaacgucccauccgaagaggucgugaagaagaugaagaacuacuggagacagcugcugaacgcgaaacugauuacccagagaaaguuugacaaccucaccaaagcugagagaggaggccugagcgagcuggacaaggcugguuucaucaagcggcagcuaguggaaacacggcaaaucaccaagcacguggcucaaauccuagauagcagaaugaauaccaaguacgaugagaacgacaaacugaucagagaagugaaggugaucacauuaaagucuaaacuggucagcgacuucagaaaggacuuccaguucuacaaagucagagagaucaacaacuaccaccacgcccacgacgccuaccugaacgccguggugggcaccgcccugaucaagaaguaucccaagcuggaguccgaauucguguacggcgacuacaagguguacgacgugcggaagaugaucgccaagucugaacaggagaucggcaaggccaccgccaaguauuucuucuacagcaacauuaugaacuucuucaagaccgagaucacccuggcuaauggagagaucagaaagcgcccccugaucgaaaccaacggagaaaccggcgagaucgugugggacaagggcagagacuucgccaccgugagaaagguguuguccaugccucaggugaacaucgugaagaagacagaggugcagacaggaggguuuagcaaggagagcauccugccuaaacggaacagcgacaagcugaucgccagaaagaaggacugggauccuaagaaauacggcggcuucgauuccccuaccguggccuacagcgugcuggugguggccaaggucgagaagggcaagagcaagaaacugaaguccgugaaggaacugcugggaaucaccaucauggaaagaucuagcuucgagaagaauccuaucgacuuccuggaagccaagggcuauaaagaggugaagaaagaccugaucaucaagcucccgaaguacagccuguucgagcuggagaacggccgcaagcggaugcuggccuccgccggcgagcugcagaagggcaaugagcucgcccugccuucuaaauacgugaacuuccuguaccuggccucgcacuacgagaagcucaagggcaguccagaggacaacgagcagaaacagcuguucguggaacaacacaagcacuaccuggaugagauuaucgagcagaucagcgaguucuccaaacgggugauccuggcggaugcuaaccuagauaagguucugagcgccuacaacaagcaccgcgacaagccuauaagagaacaggccgagaauaucauccaccuguucacccugaccaaccugggcgcaccugcugccuucaaguacuucgacaccaccaucgacagaaagagauacacaagcaccaaggagguucuggacgccacccugauacaccagagcaucacaggucuguaugaaacccggaucgaccugucucagcugggcggugacgaaggugcugacaagagaaccgccgacggcagcgaguucgagagccccaagaagaagcgcaaggugugagcggccgcuuaauuaagcugccuucugcggggcuugccuucuggccaugcccuucuucucucccuugcaccuguaccucuuggucuuugaauaaagccugaguaggaagucuaga

SEQ ID NO: 2175 - RNA, 501 nt, Artificial Sequence
  Description of Artificial Sequence: Synthetic polynucleotide
augucugagguggaguucucccacgaguacuggaugcggcaugcucugacuuuggccaagagagcccgagaugagcgggaggucccugugggcgcagugcuggugcugaacaacagggugaucggcgagggcuggaaccgggccaucggccugcacgacccuacagcucacgccgagaucauggcccuuagacagggcggccuggugaugcagaacuacagacugaucgacgccacacuguacgucaccuuugagccuugcgugaugugcgccggagccaugauccauagccggauaggacggguggucuuuggcgugcggaacgcgaagaccggcgccgccggcagccuuauggaugugcugcaccauccuggcaugaaccacaggguggagaucaccgaaggcauccuggcugaugaaugugccgcucugcugugcagauucuuucggaugccuagaagaguguucaacgcccagaagaaagcccagaguagcaccgau

SEQ ID NO: 2176 - RNA, 96 nt, Artificial Sequence
  Description of Artificial Sequence: Synthetic oligonucleotide
agcggcggcagcagcggcggcagcagcggaagcgagacaccuggcaccagcgaauccgccacaccugagagcucuggaggaagcucaggcggcucu

SEQ ID NO: 2177 - RNA, 4101 nt, Artificial Sequence
  Description of Artificial Sequence: Synthetic polynucleotide
gacaagaaauacucaaucggacuggccaucggcaccaauagcgugggcugggccgugaucacagaugaauauaaggugccuagcaagaaguucaaggugcugggcaacaccgauagacacagcaucaagaagaaccugaucggagcccugcuguucgacagcggcgaaaccgccgaagccaccagacugaagagaaccgccagaagacgguacacccggcguaagaacaggaucuguuaccugcaggagaucuucagcaacgaaauggccaagguggacgacucuuucuuccacagacuggaggagagcuuucugguggaagaagacaagaagcaugagcggcaccccaucuuuggcaacaucguggacgaaguggccuaccacgagaaauacccaacaaucuaucaccugagaaagaagcugguggacagcaccgauaaggccgaccugcggcugaucuaccuggcccuggcacacaugaucaaguucagaggccacuuccugaucgagggcgaccugaaccccgauaauagcgauguggauaagcuguucauccagcuggugcagaccuacaaccagcuguucgaggagaacccgaucaacgccucgggaguugaugccaaggcaauccugucugcuagacugaguaagagcagaagacuggagaaccugaucgcccagcugcccggagagaagaagaaugggcuguuuggcaaccugauugcccugucucugggccuuacaccuaacuucaagagcaacuuugaccuggccgaagacgccaagcugcaacugucuaaggauaccuacgacgacgaucuggacaaccugcuggcccaaaucggggaucaauacgccgaccuguuccuggcugccaagaaucugucugacgccauccuucuguccgauauccugcgggugaacacagagauaaccaaagcuccucuuagugcgagcaugaucaagagauaugaugagcaccaccaagaucugacgcuccugaaggcccuggucagacagcagcucccugagaaauacaaggaaauuuucuucgaccagagcaagaauggcuacgccggcuacaucgauggcggcgccagccaggaggaauuuuacaaguuuaucaaaccaauccucgagaagauggacggcaccgaggaacugcucgugaagcugaacagagaggaccuacugcggaagcagcggacguucgacaacggcagcaucccucaccagauccaccugggugagcugcacgcaauccugagaagacaggaagauuucuaccccuuccugaaagacaaccgggagaagaucgagaagauccugacauuuagaauucccuacuacgugggcccucuggcuagaggcaacucccgguucgccuggaugacccggaaguccgaagaaaccaucacccccuggaacuuugaggagguaguggacaagggcgccagcgcucagagcuuuauagagagaaugaccaacuucgacaagaaucugccaaacgagaaaguccugccuaagcacucucugcuguaugaguacuucaccguuuacaacgagcugacaaaggugaaauacgugacggaggggaugaggaagcccgccuuccugagcggcgaacagaagaaggcuaucguugaccugcuguucaagaccaauaggaaggugaccgugaagcagcucaaggaggacuacuucaagaagauugagugcuucgacucuguggaaaucucuggaguugaggaccgguucaacgcaucccugggaacauaccacgaucugcugaagaucauuaaggacaaggacuuucuggacaaugaggagaacgaagauauccuggaggacauugugcugacccugacacuguuugaagaucgugaaaugaucgaagaacggcugaagacauacgcccaucuguucgacgacaagguuaugaagcagcugaagagaagaagauauacaggguggggcaggcuguccaggaaacugaucaacggcauccgggacaagcagagcggcaagacaauucuggacuuccucaagagcgacggcuucgccaacagaaauuuuaugcagcugauccaugacgauagccugacauucaaggaagacauccagaaggcccaggugagcgggcaaggcgacagccugcacgagcacaucgccaaccuggccggcucucccgcuaucaagaagggaauccugcagacagugaaggugguugaugaguuagugaaagugaugggccggcacaagccugagaauaucgugauugaaauggccagagagaaccagacaacucagaagggccagaagaacucccgagagagaaugaagagaaucgaagagggaaucaaagagcuaggcagccaaauccucaaagaacaccccguggagaauacccagcugcagaacgagaagcuguaccuguacuaccugcagaacggccgagauauguacguggaucaggagcuggacaucaauaggcugucagacuacgacguggaccacaucgugccucagagcuuucugaaggaugauucuaucgacaacaagguguuaaccagauccgacaagaacagaggcaagagcgauaacgucccauccgaagaggucgugaagaagaugaagaacuacuggagacagcugcugaacgcgaaacugauuacccagagaaaguuugacaaccucaccaaagcugagagaggaggccugagcgagcuggacaaggcugguuucaucaagcggcagcuaguggaaacacggcaaaucaccaagcacguggcucaaauccuagauagcagaaugaauaccaaguacgaugagaacgacaaacugaucagagaagugaaggugaucacauuaaagucuaaacuggucagcgacuucagaaaggacuuccaguucuacaaagucagagagaucaacaacuaccaccacgcccacgacgccuaccugaacgccguggugggcaccgcccugaucaagaaguaucccaagcuggaguccgaauucguguacggcgacuacaagguguacgacgugcggaagaugaucgccaagucugaacaggagaucggcaaggccaccgccaaguauuucuucuacagcaacauuaugaacuucuucaagaccgagaucacccuggcuaauggagagaucagaaagcgcccccugaucgaaaccaacggagaaaccggcgagaucgugugggacaagggcagagacuucgccaccgugagaaagguguuguccaugccucaggugaacaucgugaagaagacagaggugcagacaggaggguuuagcaaggagagcauccugccuaaacggaacagcgacaagcugaucgccagaaagaaggacugggauccuaagaaauacggcggcuucgauuccccuaccguggccuacagcgugcuggugguggccaaggucgagaagggcaagagcaagaaacugaaguccgugaaggaacugcugggaaucaccaucauggaaagaucuagcuucgagaagaauccuaucgacuuccuggaagccaagggcuauaaagaggugaagaaagaccugaucaucaagcucccgaaguacagccuguucgagcuggagaacggccgcaagcggaugcuggccuccgccggcgagcugcagaagggcaaugagcucgcccugccuucuaaauacgugaacuuccuguaccuggccucgcacuacgagaagcucaagggcaguccagaggacaacgagcagaaacagcuguucguggaacaacacaagcacuaccuggaugagauuaucgagcagaucagcgaguucuccaaacgggugauccuggcggaugcuaaccuagauaagguucugagcgccuacaacaagcaccgcgacaagccuauaagagaacaggccgagaauaucauccaccuguucacccugaccaaccugggcgcaccugcugccuucaaguacuucgacaccaccaucgacagaaagagauacacaagcaccaaggagguucuggacgccacccugauacaccagagcaucacaggucuguaugaaacccggaucgaccugucucagcugggcggugac

SEQ ID NO: 2178 - RNA, 12 nt, Artificial Sequence
  Description of Artificial Sequence: Synthetic oligonucleotide
gaaggugcugac

SEQ ID NO: 2179 - RNA, 57 nt, Artificial Sequence
  Description of Artificial Sequence: Synthetic oligonucleotide
aagagaaccgccgacggcagcgaguucgagagccccaagaagaagcgcaagguguga

SEQ ID NO: 2180 - DNA, 4767 bp, Artificial Sequence
  Description of Artificial Sequence: Synthetic polynucleotide
atgtccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgactctggtggttcttctggtggttctagcggcagcgagactcccgggacctcagagtccgccacacccgaaagttctggtggttcttctggtggttctgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacgagggagctgataagcgcaccgccgatggttccgagttcgaaagccccaagaagaagaggaaagtctaa

SEQ ID NO: 2181 - DNA, 501 bp, Artificial Sequence
  Description of Artificial Sequence: Synthetic polynucleotide
atgtccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgac

SEQ ID NO: 2182 - DNA, 96 bp, Artificial Sequence
  Description of Artificial Sequence: Synthetic oligonucleotide
tctggtggttcttctggtggttctagcggcagcgagactcccgggacctcagagtccgccacacccgaaagttctggtggttcttctggtggttct

SEQ ID NO: 2183 - DNA, 4101 bp, Artificial Sequence
  Description of Artificial Sequence: Synthetic polynucleotide
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 2184 - DNA, 12 bp, Artificial Sequence
  Description of Artificial Sequence: Synthetic oligonucleotide
gagggagctgat

SEQ ID NO: 2185 - DNA, 57 bp, Artificial Sequence
  Description of Artificial Sequence: Synthetic oligonucleotide
aagcgcaccgccgatggttccgagttcgaaagccccaagaagaagaggaaagtctaa

SEQ ID NO: 2186 - RNA, 4380 nt, Artificial Sequence
  Description of Artificial Sequence: Synthetic polynucleotide
aggaaauaagagagaaaagaagaguaagaagaaauauaagagccaccauggcccccaagaagaagcggaaggugggcauccacggcgugcccgccgccgacaagaaguacagcaucggccuggacaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacggccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacgaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacgcggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacgaacggcgagacgggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacgcggaucgaccugagccagcugggcggcgacagcggcggcaagcggcccgccgccaccaagaaggccggccaggccaagaagaagaaguaaugauaggcggccgcuuaauuaagcugccuucugcggggcuugccuucuggccaugcccuucuucucucccuugcaccuguaccucuuggucuuugaauaaagccugaguaggaagucuaga

SEQ ID NO: 2187 - RNA, 4218 nt, Artificial Sequence
  Description of Artificial Sequence: Synthetic polynucleotide
auggcccccaagaagaagcggaaggugggcauccacggcgugcccgccgccgacaagaaguacagcaucggccuggacaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacggccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacgaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacgcggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacgaacggcgagacgggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacgcggaucgaccugagccagcugggcggcgacagcggcggcaagcggcccgccgccaccaagaaggccggccaggccaagaagaagaaguaaugauag

SEQ ID NO: 2188 - protein, 1403 aa, Artificial Sequence
  Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGKRPAATKKAGQAKKKK

SEQ ID NO: 2189 - RNA, 4380 nt, Artificial Sequence
  Description of Artificial Sequence: Synthetic polynucleotide
aggaaauaagagagaaaagaagaguaagaagaaauauaagagccaccauggcccccaagaagaagcgcaaggugggcauccacggcgugcccgccgccgacaagaaguacagcaucggccuggacaucggcaccaacagcgugggcugggccgugaucaccgacgaguacaaggugcccagcaagaaguucaaggugcugggcaacaccgaccgccacagcaucaagaagaaccugaucggcgcccugcuguucgacagcggcgagacagccgaggccacccgccugaagcgcaccgcccgccgccgcuacacccgccgcaagaaccgcaucugcuaccugcaggagaucuucagcaacgagauggccaagguggacgacagcuucuuccaccgccuggaggagagcuuccugguggaggaggacaagaagcacgagcgccaccccaucuucggcaacaucguggacgagguggccuaccacgagaaguaccccaccaucuaccaccugcgcaagaagcugguggacagcaccgacaaggccgaccugcgccugaucuaccuggcccuggcccacaugaucaaguuccgcggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccgccugagcaagagccgccgccuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgcgugaacaccgagaucaccaaggccccccugagcgccagcaugaucaagcgcuacgacgagcaccaccaggaccugacccugcugaaggcccuggugcgccagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgcgaggaccugcugcgcaagcagcgcaccuucgacaacggcagcaucccccaccagauccaccugggcgagcugcacgccauccugcgccgccaggaggacuucuaccccuuccugaaggacaaccgcgagaagaucgagaagauccugaccuuccgcauccccuacuacgugggcccccuggcccgcggcaacagccgcuucgccuggaugacccgcaagagcgaggagacaaucacccccuggaacuucgaggaggugguggacaagggcgccagcgcccagagcuucaucgagcgcaugaccaacuucgacaagaaccugcccaacgagaaggugcugcccaagcacagccugcuguacgaguacuucaccguguacaacgagcugaccaaggugaaguacgugaccgagggcaugcgcaagcccgccuuccugagcggcgagcagaagaaggccaucguggaccugcuguucaagaccaaccgcaaggugaccgugaagcagcugaaggaggacuacuucaagaagaucgagugcuucgacagcguggagaucagcggcguggaggaccgcuucaacgccagccugggcaccuaccacgaccugcugaagaucaucaaggacaaggacuuccuggacaacgaggagaacgaggacauccuggaggacaucgugcugacccugacccuguucgaggaccgcgagaugaucgaggagcgccugaagaccuacgcccaccuguucgacgacaaggugaugaagcagcugaagcgccgccgcuacaccggcuggggccgccugagccgcaagcugaucaacggcauccgcgacaagcagagcggcaagaccauccuggacuuccucaagagcgacggcuucgccaaccgcaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccgccacaagcccgagaacaucgugaucgagauggcccgcgagaaccagaccacccagaagggccagaagaacagccgcgagcgcaugaagcgcaucgaggagggcaucaaggagcugggcagccagauccugaaggagcaccccguggagaacacccagcugcagaacgagaagcuguaccuguacuaccugcagaacggccgcgacauguacguggaccaggagcuggacaucaaccgccugagcgacuacgacguggaccacaucgugccccagagcuuccugaaggacgacagcaucgacaacaaggugcugacccgcagcgacaagaaccgcggcaagagcgacaacgugcccagcgaggagguggugaagaagaugaagaacuacuggcgccagcugcugaacgccaagcugaucacccagcgcaaguucgacaaccugaccaaggccgagcgcggcggccugagcgagcuggacaaggccggcuucaucaagcgccagcugguggagacacgccagaucaccaagcacguggcccagauccuggacagccgcaugaacaccaaguacgacgagaacgacaagcugauccgcgaggugaaggugaucacccucaagagcaagcuggugagcgacuuccgcaaggacuuccaguucuacaaggugcgcgagaucaacaacuaccaccacgcccacgacgccuaccugaacgccguggugggcaccgcccugaucaagaaguaccccaagcuggagagcgaguucguguacggcgacuacaagguguacgacgugcgcaagaugaucgccaagagcgagcaggagaucggcaaggccaccgccaaguacuucuucuacagcaacaucaugaacuucuucaagaccgagaucacccuggccaacggcgagauccgcaagcgcccccugaucgagacaaacggcgagacaggcgagaucgugugggacaagggccgcgacuucgccaccgugcgcaaggugcugagcaugccccaggugaacaucgugaagaagaccgaggugcagaccggcggcuucagcaaggagagcauccugcccaagcgcaacagcgacaagcugaucgcccgcaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcgcagcagcuucgagaagaaccccaucgacuuccuggaggccaagggcuacaaggaggugaagaaggaccugaucaucaagcugcccaaguacagccuguucgagcuggagaacggccgcaagcgcaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgcgugauccuggccgacgccaaccuggacaaggugcugagcgccuacaacaagcaccgcgacaagcccauccgcgagcaggccgagaacaucauccaccuguucacccugaccaaccugggcgcccccgccgccuucaaguacuucgacaccaccaucgaccgcaagcgcuacaccagcaccaaggaggugcuggacgccacccugauccaccagagcaucaccggccuguacgagacacgcaucgaccugagccagcugggcggcgacagcggcggcaagcgccccgccgccaccaagaaggccggccaggccaagaagaagaaguaauaauaagcggccgcuuaauuaagcugccuucugcggggcuugccuucuggccaugcccuucuucucucccuugcaccuguaccucuuggucuuugaauaaagccugaguaggaagucuaga

SEQ ID NO: 2190 - RNA, 4218 nt, Artificial Sequence
  Description of Artificial Sequence: Synthetic polynucleotide
auggcccccaagaagaagcgcaaggugggcauccacggcgugcccgccgccgacaagaaguacagcaucggccuggacaucggcaccaacagcgugggcugggccgugaucaccgacgaguacaaggugcccagcaagaaguucaaggugcugggcaacaccgaccgccacagcaucaagaagaaccugaucggcgcccugcuguucgacagcggcgagacagccgaggccacccgccugaagcgcaccgcccgccgccgcuacacccgccgcaagaaccgcaucugcuaccugcaggagaucuucagcaacgagauggccaagguggacgacagcuucuuccaccgccuggaggagagcuuccugguggaggaggacaagaagcacgagcgccaccccaucuucggcaacaucguggacgagguggccuaccacgagaaguaccccaccaucuaccaccugcgcaagaagcugguggacagcaccgacaaggccgaccugcgccugaucuaccuggcccuggcccacaugaucaaguuccgcggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccgccugagcaagagccgccgccuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgcgugaacaccgagaucaccaaggccccccugagcgccagcaugaucaagcgcuacgacgagcaccaccaggaccugacccugcugaaggcccuggugcgccagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgcgaggaccugcugcgcaagcagcgcaccuucgacaacggcagcaucccccaccagauccaccugggcgagcugcacgccauccugcgccgccaggaggacuucuaccccuuccugaaggacaaccgcgagaagaucgagaagauccugaccuuccgcauccccuacuacgugggcccccuggcccgcggcaacagccgcuucgccuggaugacccgcaagagcgaggagacaaucacccccuggaacuucgaggaggugguggacaagggcgccagcgcccagagcuucaucgagcgcaugaccaacuucgacaagaaccugcccaacgagaaggugcugcccaagcacagccugcuguacgaguacuucaccguguacaacgagcugaccaaggugaaguacgugaccgagggcaugcgcaagcccgccuuccugagcggcgagcagaagaaggccaucguggaccugcuguucaagaccaaccgcaaggugaccgugaagcagcugaaggaggacuacuucaagaagaucgagugcuucgacagcguggagaucagcggcguggaggaccgcuucaacgccagccugggcaccuaccacgaccugcugaagaucaucaaggacaaggacuuccuggacaacgaggagaacgaggacauccuggaggacaucgugcugacccugacccuguucgaggaccgcgagaugaucgaggagcgccugaagaccuacgcccaccuguucgacgacaaggugaugaagcagcugaagcgccgccgcuacaccggcuggggccgccugagccgcaagcugaucaacggcauccgcgacaagcagagcggcaagaccauccuggacuuccucaagagcgacggcuucgccaaccgcaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccgccacaagcccgagaacaucgugaucgagauggcccgcgagaaccagaccacccagaagggccagaagaacagccgcgagcgcaugaagcgcaucgaggagggcaucaaggagcugggcagccagauccugaaggagcaccccguggagaacacccagcugcagaacgagaagcuguaccuguacuaccugcagaacggccgcgacauguacguggaccaggagcuggacaucaaccgccugagcgacuacgacguggaccacaucgugccccagagcuuccugaaggacgacagcaucgacaacaaggugcugacccgcagcgacaagaaccgcggcaagagcgacaacgugcccagcgaggagguggugaagaagaugaagaacuacuggcgccagcugcugaacgccaagcugaucacccagcgcaaguucgacaaccugaccaaggccgagcgcggcggccugagcgagcuggacaaggccggcuucaucaagcgccagcugguggagacacgccagaucaccaagcacguggcccagauccuggacagccgcaugaacaccaaguacgacgagaacgacaagcugauccgcgaggugaaggugaucacccucaagagcaagcuggugagcgacuuccgcaaggacuuccaguucuacaaggugcgcgagaucaacaacuaccaccacgcccacgacgccuaccugaacgccguggugggcaccgcccugaucaagaaguaccccaagcuggagagcgaguucguguacggcgacuacaagguguacgacgugcgcaagaugaucgccaagagcgagcaggagaucggcaaggccaccgccaaguacuucuucuacagcaacaucaugaacuucuucaagaccgagaucacccuggccaacggcgagauccgcaagcgcccccugaucgagacaaacggcgagacaggcgagaucgugugggacaagggccgcgacuucgccaccgugcgcaaggugcugagcaugccccaggugaacaucgugaagaagaccgaggugcagaccggcggcuucagcaaggagagcauccugcccaagcgcaacagcgacaagcugaucgcccgcaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcgcagcagcuucgagaagaaccccaucgacuuccuggaggccaagggcuacaaggaggugaagaaggaccugaucaucaagcugcccaaguacagccuguucgagcuggagaacggccgcaagcgcaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgcgugauccuggccgacgccaaccuggacaaggugcugagcgccuacaacaagcaccgcgacaagcccauccgcgagcaggccgagaacaucauccaccuguucacccugaccaaccugggcgcccccgccgccuucaaguacuucgacaccaccaucgaccgcaagcgcuacaccagcaccaaggaggugcuggacgccacccugauccaccagagcaucaccggccuguacgagacacgcaucgaccugagccagcugggcggcgacagcggcggcaagcgccccgccgccaccaagaaggccggccaggccaagaagaagaaguaauaauaa

SEQ ID NO: 2191 - RNA, 100 nt, Artificial Sequence; identical to SEQ ID NO: 1636
  Description of Artificial Sequence: Synthetic polynucleotide

SEQ ID NO: 2192 - RNA, 4929 nt, Artificial Sequence
  Description of Artificial Sequence: Synthetic polynucleotide
aggaaauaagagagaaaagaagaguaagaagaaauauaagagccaccaugagcgagguggaguucagccacgaguacuggaugcggcacgcccugacccuggccaagcgggcccgggacgagcgggaggugcccgugggcgccgugcuggugcugaacaaccgggugaucggcgagggcuggaaccgggccaucggccugcacgaccccaccgcccacgccgagaucauggcccugcggcagggcggccuggugaugcagaacuaccggcugaucgacgccacccuguacgugaccuucgagcccugcgugaugugcgccggcgccaugauccacagccggaucggccgggugguguucggcgugcggaacgccaagaccggcgccgccggcagccugauggacgugcugcaccaccccggcaugaaccaccggguggagaucaccgagggcauccuggccgacgagugcgccgcccugcugugccgguucuuccggaugccccggcggguguucaacgcccagaagaaggcccagagcagcaccgacagcggcggcagcagcggcggcagcagcggcagcgagacacccggcaccagcgagagcgccacccccgagagcagcggcggcagcagcggcggcagcgacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagacagccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccgcaagagcgaggagacaaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccucaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacacggcagaucaccaagcacguggcccagauccuggacagccggaugaacaccaaguacgacgagaacgacaagcugauccgggaggugaaggugaucacccucaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagacaaacggcgagacaggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcucaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacacggaucgaccugagccagcugggcggcgacgagggcgccgacaagcggaccgccgacggcagcgaguucgagagccccaagaagaagcggaaggugugagcggccgcuuaauuaagcugccuucugcggggcuugccuucuggccaugcccuucuucucucccuugcaccuguaccucuuggucuuugaauaaagccugaguaggaagucuaga

SEQ ID NO: 2193 - DNA, 22 bp, Artificial Sequence
  Description of Artificial Sequence: Synthetic oligonucleotide
cccgcacctggcacagagaggg

SEQ ID NO: 2194 - DNA, 23 bp, Artificial Sequence
  Description of Artificial Sequence: Synthetic oligonucleotide
cagcaccttggcagcagaggtgg

SEQ ID NO: 2195 - DNA, 22 bp, Artificial Sequence
  Description of Artificial Sequence: Synthetic oligonucleotide
cccgcacctggtgcagcaagtg

SEQ ID NO: 2196 - DNA, 22 bp, Artificial Sequence
  Description of Artificial Sequence: Synthetic oligonucleotide
accgcaccaggcccagcggcgg

SEQ ID NO: 2197 - DNA, 22 bp, Artificial Sequence
  Description of Artificial Sequence: Synthetic oligonucleotide
accacacctggcccagcagagg

SEQ ID NO: 2198 - DNA, 23 bp, Artificial Sequence
  Description of Artificial Sequence: Synthetic oligonucleotide
cctgcaccttggagcagcagggg

SEQ ID NO: 2199 - DNA, 23 bp, Artificial Sequence
  Description of Artificial Sequence: Synthetic oligonucleotide
ccagcaccttagtgcagcagaag

SEQ ID NO: 2200 - DNA, 23 bp, Artificial Sequence
  Description of Artificial Sequence: Synthetic oligonucleotide
cccgcacccagacacagcggcgg

SEQ ID NO: 2201 - DNA, 22 bp, Artificial Sequence
  Description of Artificial Sequence: Synthetic oligonucleotide
cccacacctggcacagcgccgg

SEQ ID NO: 2202 - DNA, 23 bp, Artificial Sequence
  Description of Artificial Sequence: Synthetic oligonucleotide
ccgcactcatggagcagctgtgg

SEQ ID NO: 2203 - DNA, 22 bp, Artificial Sequence
  Description of Artificial Sequence: Synthetic oligonucleotide
gccgcacctggcgcaggggagg

SEQ ID NO: 2204 - DNA, 23 bp, Artificial Sequence
  Description of Artificial Sequence: Synthetic oligonucleotide
cccacacctaggcacagctaggg

SEQ ID NO: 2205 - DNA, 23 bp, Artificial Sequence
  Description of Artificial Sequence: Synthetic oligonucleotide
accacaccttggtgcaaaggagg

SEQ ID NO: 2206 - DNA, 23 bp, Artificial Sequence
  Description of Artificial Sequence: Synthetic oligonucleotide
aatgcaccttggcatagtggggg

SEQ ID NO: 2207 - DNA, 23 bp, Artificial Sequence
  Description of Artificial Sequence: Synthetic oligonucleotide
gccgcaccttggcacaccagtgg

SEQ ID NO: 2208 - DNA, 22 bp, Artificial Sequence
  Description of Artificial Sequence: Synthetic oligonucleotide
cccacacctggcccagcggggc

SEQ ID NO: 2209 - DNA, 23 bp, Artificial Sequence
  Description of Artificial Sequence: Synthetic oligonucleotide
gtggcaccttggtgcagccaagg

SEQ ID NO: 2210 - DNA, 23 bp, Artificial Sequence
  Description of Artificial Sequence: Synthetic oligonucleotide
ccagcaccctagtgcagcgtggg

SEQ ID NO: 2211 - DNA, 22 bp, Artificial Sequence
  Description of Artificial Sequence: Synthetic oligonucleotide
cccacacatggagcagcagggg

SEQ ID NO: 2212 - DNA, 23 bp, Artificial Sequence
  Description of Artificial Sequence: Synthetic oligonucleotide
aagcaccttggcagcagctgagg

SEQ ID NO: 2213 - DNA, 23 bp, Artificial Sequence
  Description of Artificial Sequence: Synthetic oligonucleotide
tctgcaccttggcccagcgtaag

SEQ ID NO: 2214 - DNA, 22 bp, Artificial Sequence
  Description of Artificial Sequence: Synthetic oligonucleotide
cccgcacctggctcagcagtga

SEQ ID NO: 2215 - DNA, 22 bp, Artificial Sequence
  Description of Artificial Sequence: Synthetic oligonucleotide
cccgcactgggtgcagaggtgg

SEQ ID NO: 2216 - DNA, 22 bp, Artificial Sequence
  Description of Artificial Sequence: Synthetic oligonucleotide
cccgcactcggcgcagccatgg

SEQ ID NO: 2217 - DNA, 22 bp, Artificial Sequence
  Description of Artificial Sequence: Synthetic oligonucleotide
cccgcacccggcgtagcgacgg

SEQ ID NO: 2218 - DNA, 23 bp, Artificial Sequence
  Description of Artificial Sequence: Synthetic oligonucleotide
gctgcaccctgccgcagaggagg

SEQ ID NO: 2219 - DNA, 23 bp, Artificial Sequence
  Description of Artificial Sequence: Synthetic oligonucleotide
gagcaccttggcagcagctgagg

SEQ ID NO: 2220 - DNA, 22 bp, Artificial Sequence
  Description of Artificial Sequence: Synthetic oligonucleotide
cccgcacctggcgcagcgcccg

SEQ ID NO: 2221 - DNA, 23 bp, Artificial Sequence
  Description of Artificial Sequence: Synthetic oligonucleotide
atggcaccttggcacagcagagg

SEQ ID NO: 2222 - DNA, 23 bp, Artificial Sequence
  Description of Artificial Sequence: Synthetic oligonucleotide
gaggcaccatgacgcagcagtgg

SEQ ID NO: 2223 - DNA, 23 bp, Artificial Sequence
  Description of Artificial Sequence: Synthetic oligonucleotide
cccacaacctggcacagaggcgg

SEQ ID NO: 2224 - DNA, 23 bp, Artificial Sequence
  Description of Artificial Sequence: Synthetic oligonucleotide
tctgcaccatggtgcagctgagg

SEQ ID NO: 2225 - DNA, 22 bp, Artificial Sequence
  Description of Artificial Sequence: Synthetic oligonucleotide
accgcacctggcccagccaggg

SEQ ID NO: 2226 - DNA, 23 bp, Artificial Sequence
  Description of Artificial Sequence: Synthetic oligonucleotide
ccagcaccttggcacagagtagg

SEQ ID NO: 2227 - DNA, 22 bp, Artificial Sequence
  Description of Artificial Sequence: Synthetic oligonucleotide
cccgcagttggcccagctgagg

SEQ ID NO: 2228 - DNA, 23 bp, Artificial Sequence
  Description of Artificial Sequence: Synthetic oligonucleotide
ccagcacctttgtgcagtggagg

SEQ ID NO: 2229 - DNA, 23 bp, Artificial Sequence
  Description of Artificial Sequence: Synthetic oligonucleotide
ccagcaccaagacacagcagtgg

SEQ ID NO: 2230 - DNA, 23 bp, Artificial Sequence
  Description of Artificial Sequence: Synthetic oligonucleotide
ttagcatcttggtgcagaggtgg

What is claimed is:

1. A composition for editing a gene target comprising:
   (i) an mRNA encoding a base editor protein comprising a DNA binding domain and a deaminase, wherein the mRNA comprises a sequence having at least 95% sequence identity to SEQ ID NO: 2192, and
   (ii) a guide RNA comprising a tracr sequence that serves as a binding scaffold for the base editor protein, and a spacer sequence that corresponds to a protospacer on ANGPTL3.

2. A composition for editing a gene target comprising:
   (i) an mRNA encoding a base editor protein comprising a DNA binding domain and a deaminase, wherein the mRNA comprises a sequence having at least 95% sequence identity to the coding sequence of SEQ ID NO: 2192, and
   (ii) a guide RNA comprising a tracr sequence that serves as a binding scaffold for the base editor protein, and a spacer sequence that corresponds to a protospacer ANGPTL3.

3. The composition of claim 1 or 2, wherein the mRNA comprises a sequence having at least 99% sequence identity to SEQ ID NO: 2192.

4. The composition of claim 1 or 2, wherein the mRNA comprises a 5'UTR having at least 95% identity to the sequence of (SEQ ID NO: 2138)
AGGAAAu'AAGAGAGAAAAGAAGAGu'AAGAAGAAAu'Au'AAGAGCCA
CC.

5. The composition of claim 1 or 2, wherein the mRNA comprises a 3'UTR having at least 95% identity to the sequence of (SEQ ID NO: 2147)
GCGGCCGCu'u'AAu'u'AAGCu'GCCu'u'Cu'GCGGGGCu'u'GCCu' u'Cu'GGCCAu'GCCCu'u'Cu'u'Cu'Cu'CCCu'u'GCACCu'Gu'AC

Cu'Cu'u'GGu'Cu'u'u'GAAu'AAAGCCu'GAGu'AGGAAGu'Cu'AG

A.

6. The composition of claim 1 or 2, wherein the mRNA encoding the base editor protein comprises a GC % content greater than 50%.

7. The composition of claim 1 or 2, wherein the base editor protein further comprises an adenine tRNA deaminase (TadA) region, a Cas9 nickase region and a nuclear localization sequence (NLS) region.

8. The composition of claim 7, wherein the GC % content of the mRNA encoding the TadA region of the base editor protein is greater than 60%.

9. The composition of claim 7, wherein the GC % content of the mRNA encoding the Cas9 nickase region of the base editor protein is greater than 56%.

10. The composition of claim 7, wherein the GC % content of the mRNA encoding the NLS region of the base editor protein is greater than 54%.

11. The composition of claim 1 or 2, wherein the mRNA comprises a sequence selected from the group consisting of MA004, MA040, MA041, and MA045.

12. The composition of claim 11, wherein the mRNA comprises MA004.

13. The composition of claim 1 or 2, wherein the ratio of the guide RNA and the mRNA encoding the base editor protein is from about 1:10 to about 10:1 by weight.

14. The composition of claim 1 or 2, wherein the guide RNA further comprises a chemical modification on one or more nucleotides.

15. The composition of claim 14, wherein the chemical modification is selected from the group consisting of 2'-O-methyl modifications, 2'-O-(2-methoxyethyl) modifications, 2'-fluoro modifications, phosphonothioate modifications, inverted abasic modifications, deoxyribonucleotides, bicyclic ribose analog (e.g., locked nucleic acid (LNA), C-ethylene-bridged nucleic acid (ENA), bridged nucleic acid (BNA), unlocked nucleic acid (UNA)), base or nucleobase modifications, internucleoside linkage modifications, ribonebularine, 2'-O-methylnebularine, and 2'-deoxynebularine.

16. The composition of claim 1 or 2, wherein the guide RNA directs the base editor protein to effect a nucleobase alteration in the ANGPTL3 gene.

17. The composition of claim 16, wherein the nucleobase alteration results in a frame shift, a premature stop codon, an insertion or deletion in a transcript encoded by the ANGPTL3 gene.

18. The composition of claim 16, wherein the nucleobase alteration results in an aberrant transcript encoded by the ANGPTL3 gene.

19. The composition of claim 16, wherein the nucleobase alteration is at a splice donor site of the ANGPTL3 gene.

20. The composition of claim 19, wherein the splice donor site is at 5' end of ANGPTL3 intron 6 as referenced in SEQ ID NO: 7.

21. The composition of claim 16, wherein the protospacer comprises a sequence having at least 80% sequence identity to the sequences of (SEQ ID No: 14)
5'-AAGATACCTGAATAACTCTC-3', (SEQ ID No: 15)
5'-AAGATACCTGAATAACCCTC-3', (SEQ ID No: 1606)
5'-GATACCTGAATAACTCTC-3', (SEQ ID No: 248)
5'-AGATACCTGAATAACCCTC-3', or (SEQ ID No: 249)
5'-GATACCTGAATAACCCTC-3'.

22. The composition of claim 1 or 2, wherein the guide RNA comprises a spacer sequence having at least 80% sequence identity to a spacer sequence of a guide RNA selected from the group consisting of SEQ ID No: 59, SEQ ID No: 257, SEQ ID No: 438, SEQ ID No: 439, SEQ ID No: 440, SEQ ID No: 441, SEQ ID No: 442, SEQ ID No: 443, SEQ ID No: 1652 and SEQ ID No: 445.

* * * * *